US010400243B2

(12) United States Patent
Whipple et al.

(10) Patent No.: US 10,400,243 B2
(45) Date of Patent: Sep. 3, 2019

(54) MODULATION OF UBE3A-ATS EXPRESSION

(71) Applicant: Ionis Pharmaceuticals, Inc., Carlsbad, CA (US)

(72) Inventors: Amanda Whipple, Cambridge, MA (US); Frank Rigo, Carlsbad, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 15/529,428

(22) PCT Filed: Nov. 25, 2015

(86) PCT No.: PCT/US2015/062622
§ 371 (c)(1),
(2) Date: May 24, 2017

(87) PCT Pub. No.: WO2016/086104
PCT Pub. Date: Jun. 2, 2016

(65) Prior Publication Data
US 2017/0362592 A1 Dec. 21, 2017

Related U.S. Application Data

(60) Provisional application No. 62/084,434, filed on Nov. 25, 2014.

(51) Int. Cl.
*C12N 15/113* (2010.01)
*C07H 21/04* (2006.01)
*C12N 5/00* (2006.01)

(52) U.S. Cl.
CPC .. *C12N 15/1137* (2013.01); *C12Y 603/02019* (2013.01); *C12N 2310/11* (2013.01); *C12N 2310/315* (2013.01); *C12N 2310/321* (2013.01); *C12N 2310/3231* (2013.01); *C12N 2310/3525* (2013.01)

(58) Field of Classification Search
None
See application file for complete search history.

(56) References Cited

U.S. PATENT DOCUMENTS

| | | |
|---|---|---|
| 4,981,957 A | 1/1991 | Lableu et al. |
| 5,034,506 A | 7/1991 | Summerton et al. |
| 5,118,800 A | 6/1992 | Smith et al. |
| 5,166,315 A | 11/1992 | Summerton et al. |
| 5,185,444 A | 2/1993 | Summerton et al. |
| 5,319,080 A | 6/1994 | Leumann |
| 5,359,044 A | 10/1994 | Cook et al. |
| 5,393,878 A | 2/1995 | Leumann |
| 5,446,137 A | 8/1995 | Maag et al. |
| 5,466,786 A | 11/1995 | Buhr et al. |
| 5,514,785 A | 5/1996 | Van Ness et al. |
| 5,519,134 A | 5/1996 | Acevedo et al. |
| 5,567,811 A | 10/1996 | Mistura et al. |
| 5,576,427 A | 11/1996 | Cook et al. |
| 5,591,722 A | 1/1997 | Montgomery et al. |
| 5,597,909 A | 1/1997 | Urdea et al. |
| 5,610,300 A | 3/1997 | Altmann et al. |
| 5,627,053 A | 5/1997 | Usman et al. |
| 5,639,873 A | 6/1997 | Barascut et al. |
| 5,646,265 A | 7/1997 | McGee |
| 5,670,633 A | 9/1997 | Cook et al. |
| 5,698,685 A | 12/1997 | Summerton et al. |
| 5,700,920 A | 12/1997 | Altmann et al. |
| 5,792,847 A | 8/1998 | Buhr et al. |
| 5,801,154 A | 9/1998 | Baracchini et al. |
| 6,184,212 B1 | 2/2001 | Miraglia et al. |
| 6,268,490 B1 | 7/2001 | Imanishi et al. |
| 6,300,132 B1 | 10/2001 | Monia et al. |
| 6,525,191 B1 | 2/2003 | Ramasamy |
| 6,582,908 B2 | 6/2003 | Fodor et al. |
| 6,600,032 B1 | 7/2003 | Manoharan et al. |
| 6,617,162 B2 | 9/2003 | Dobie et al. |
| 6,670,461 B1 | 12/2003 | Wengel et al. |
| 6,770,748 B2 | 8/2004 | Imanishi et al. |
| 6,794,499 B2 | 9/2004 | Wengel et al. |
| 7,034,133 B2 | 4/2006 | Wengel et al. |

(Continued)

FOREIGN PATENT DOCUMENTS

| | | |
|---|---|---|
| EP | 1764108 | 3/2008 |
| WO | WO 2016/086104 | 6/1916 |

(Continued)

OTHER PUBLICATIONS

Albaek et al., "Analogues of a Locked Nucleic Acid with Three-Carbon 2',4'-Linkages: Synthesis by Ring-Closing Metathesis and Influence of Nucleic Acid Duplex Stability" J. Org. Chem. (2006) 71:7731-7740.

Allshire, "Molecular biology. RNAi and heterochromatin—a hushed-up affair" Science (2002) 297(5588):1818-1819.

Altmann et al., "Second Generation Antisense Oligonucleotides—Inhibition of PKC-α and c-raf Kinase Expression by Chimeric Oligonucleotides Incorporating 6"-Substituted Carbocyclic Nucleosides and 2"-O-Ethylene Glycol Substituted Ribonucleosides" Nuclewsodies Nucleotides. (1997) 16:917-926.

Altmann et al., "Second Generation of Antisense Oligonucleotides: From Nuclease Resistance to Biological Efficacy in Animals" Chimia. (1996) 50(4):168-176.

(Continued)

*Primary Examiner* — Sean McGarry
(74) *Attorney, Agent, or Firm* — McNeill Baur PLLC

(57) ABSTRACT

Certain embodiments are directed to methods and compounds for inhibiting UBE3A-ATS, the endogenous antisense transcript of ubiquitin protein ligase E3A (UBE3A). Such methods and compounds are useful for. Several embodiments provided herein relate to the discovery that antisense compounds targeting UBE3A-ATS induce paternal expression of UBE3A. Several embodiments are drawn to methods and compounds for inducing paternal expression of UBE3A using antisense compounds targeting UBE3A-ATS within a region of UBE3A-ATS that includes the sequence of the small nucleolar RNA (snoRNA), HBII-85 (also referred to as SNORD116).

28 Claims, No Drawings
Specification includes a Sequence Listing.

(56) References Cited

U.S. PATENT DOCUMENTS

| | | |
|---|---|---|
| 7,053,207 B2 | 5/2006 | Wengel |
| 7,399,845 B2 | 7/2008 | Seth et al. |
| 7,427,672 B2 | 9/2008 | Imanishi et al. |
| 7,547,684 B2 | 6/2009 | Seth et al. |
| 7,696,345 B2 | 4/2010 | Allerson et al. |
| 9,359,603 B2 | 6/2016 | Lutz et al. |
| 9,617,539 B2 | 4/2017 | Rigo et al. |
| 2001/0053519 A1 | 12/2001 | Fodor et al. |
| 2003/0087855 A1 | 5/2003 | Ward et al. |
| 2003/0228597 A1 | 12/2003 | Cowsert et al. |
| 2004/0171570 A1 | 9/2004 | Allerson et al. |
| 2005/0130923 A1 | 6/2005 | Bhat et al. |
| 2007/0031844 A1 | 2/2007 | Khvorova et al. |
| 2008/0039618 A1 | 2/2008 | Allerson et al. |
| 2008/0108583 A1 | 5/2008 | Feinstein et al. |
| 2009/0012281 A1 | 1/2009 | Swayze et al. |
| 2013/0225659 A1 | 8/2013 | Bennett et al. |
| 2014/0315992 A1 | 10/2014 | Hakonarson et al. |
| 2015/0191723 A1 | 7/2015 | Rigo et al. |

FOREIGN PATENT DOCUMENTS

| | | |
|---|---|---|
| WO | WO 2017/081223 | 5/1917 |
| WO | WO 1998/39352 | 9/1998 |
| WO | WO 1999/014226 | 3/1999 |
| WO | WO 2000/063364 | 10/2000 |
| WO | WO 2001/049687 | 7/2001 |
| WO | WO 2001/092582 | 12/2001 |
| WO | WO 2003/004602 | 1/2003 |
| WO | WO 2004/035765 | 10/2003 |
| WO | WO 2004/016754 | 2/2004 |
| WO | WO 2004/106356 | 12/2004 |
| WO | WO 2005/021570 | 3/2005 |
| WO | WO 2005/121371 | 12/2005 |
| WO | WO 2006/047842 | 5/2006 |
| WO | WO 2007/134181 | 11/2007 |
| WO | WO 2008/101157 | 8/2008 |
| WO | WO 2008/150729 | 12/2008 |
| WO | WO 2008/154401 | 12/2008 |
| WO | WO 2009/006478 | 1/2009 |
| WO | WO 2009/067647 | 5/2009 |
| WO | WO 2009/100320 | 8/2009 |
| WO | WO 2010/036696 | 4/2010 |
| WO | WO 2010/036698 | 4/2010 |
| WO | WO 2011/017521 | 2/2011 |
| WO | WO 2011/109398 | 9/2011 |
| WO | WO 2011/139702 | 11/2011 |
| WO | WO 2012/012467 | 1/2012 |
| WO | WO 2012/064806 | 5/2012 |
| WO | WO 2013/033230 | 7/2013 |
| WO | WO 2014/004572 | 1/2014 |

OTHER PUBLICATIONS

Altmann et al., "Second-generation antisense oligonucleotides: structure—activity relationships and the design of improved signal-transduction inhibitors" Biochem. Soc. Trans. (1996) 24:630-637.
Altschul et al., "Basic Local Alignment Search Tool" J. Mol. Biol. (1990) 215:403-410.
Baker et al., "2'-O-(2-Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" J. Biol. Chem. (1997) 272:11994-12000.
Beaudet et al., "Angelman syndrome: Drugs to awaken a paternal gene," Nature (2011) 481: 150-152.
Braasch et al., "Locked nucleic acid (LNA): fine-tuning the recognition of DNA and RNA" Chem. Biol. (2001) 8:1-7.
Braasch et al., "Novel antisense and peptide nucleic acid strategies for controlling gene expression" Biochemistry (2002) 41(14):4503-4510.
Branch et al., "A good antisense molecule is hard to find," TIBS (1998) 23:45-50.
Cattanach et al., "A candidate model for Angelman syndrome in the mouse" Mamm. Genome (1997) 8(7):472-478.
Chen et al., "Motor coordination deficits in A1pk1 mutant mice with the inserted piggyBac transposon" BMC Neruosci. (2011) 12:1.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Church et al., "Lineage-specific biology revealed by a finished genome assembly of the mouse" PLoS Biol. (2009) 7: e1000112.
Clark et al., "Purkinje cell expression of a mutant allele of SCA1 in transgenic mice leads to disparate effects on motor behaviors, followed by a progressive cerebellar dysfunction and histological alterations" J. Neurosci. (1997) 17(19):7385-7395.
Crooke et al., "Basic Principles of Antisense Therapeutics" Antisense Research and Application (1998) Chapter 1:1-50.
Crooke et al., "Pharmacokinetic Properties of Several Novel Oligonucleotide Analogs in mice" J. Pharmacol. Exp. Ther. (1996) 277(2):923-937.
Dindot et al., "The Angelman syndrome ubiquitin ligase localizes to the synapse and nucleus, and maternal deficiency results in abnormal dendritic spine morphology" Hum. Mol. Genet. (2008) 17(1):111-118.
Elayadi et al., "Application of PNA and LNA oligomers to chemotherapy" Curr. Opinion Invens. Drugs (2001) 2:558-561.
Faghihi et al., "RNAi screen indicates widespread biological function for human natuml antisense transcripts" PLoS One (2010) 5(10):e13177.
Fink et al, "Disrupted neuronal maturation in Angelman syndrome-derived induced pluripotent stem cells." Nat. Commun. (2017) 8:1-14.
Freier et al., "The ups and downs of nucleic acid duplex stability: structure-stability studies on chemically-modified DNA:RNA duplexes" Nucleic Acids Research (1997) 25(22):4429-4443.
Frieden et al., "Expanding the design horizon of antisense oligonucleotides with alpha-L-LNA" Nucleic Acids Research (2003) 31(21):6365-6372.
Gautschi et al., "Activity of a novel bc1-2/bc1-xLbispecific antisense oligonucleotide against tumors of diverse histologic origins" J. Natl. Cancer Inst. (2001) 93:463-471.
Gu et al., "Base pairing properties of D- and L-cyclohexene nucleic acids (CeNA)" Oligonucleotides (2003) 13(6):479-489.
Gu et al., "Enzymatic resolution and base pairing properties of D- and L-cyclohexenyl nucleic acids (CeNA)" Nucleosides Nucleotides Nucleic Acids (2005) 24(5-7):993-998.
Gu et al., "Synthesis of enantiomeric-pure cyclohexenyl nucleoside building blocks for oligonucleotide synthesis" Tetrahedron (2004) 60(9):2111-2123.
Hall et al., "Establishment and maintenance of a heterochromatin domain" Science (2002) 297(5590):2232-2237.
Hawkins et al., "Transcriptional regulation of Oct4 by a long non-coding RNA antisense to Oct4-pseudogene 5" Transcription (2010) 1(3):165-175.
Horvath et al., "Stereoselective synthesis of (—)-ara-cyclohexenyl-adenine" Tetrahedron Letters (2007) 48:3621-3623.
Huang et al., "Topoisomerase inhibitors unsilence the dormant allele of Ube3a in neurons" Nature (2012) 481(3780): 185-189.
Jenuwein, "Molecular biology. An RNA-guided pathway for the epigenome" Science (2002) 297(5590):2215-2218.
Jiang et al., "Mutation of the Angelman ubiquitin ligase in mice causes increased cytoplasmic p53 and deficits of contextual learning and long-term potentiation" Neruon (1998) 21(4):799-811.
Kabanov et al., "A new class of antivirals: antisense oligonucleotides combined with a hydrophobic substituent effectively inhibit influenza virus reproduction and synthesis of virus-specific proteins in MDCK cells" FEBS Lett. (1990) 259:327-330.
King et al., "Topoisomerases facilitate transcription of long genes linked to autism" Nature (2013) 501: 58-62.
Koshkin et al., "LNA (locked nucleic acids): Synthesis of the adenine, cytosine, guanine, 5-methylcytosine, thymine and uracil bicyclonucleoside monomers, oligomerisation, and unprecedented nucleic acid recognition" Tetrahedron (1998) 54:3607-3630.

(56) References Cited

OTHER PUBLICATIONS

Kumar et al., "The first analogues of LNA (locked nucleic acids): phosphorothioate-LNA and 2'-thio-LNA" Bioorg Med Chem Lett. (1998) 8:2219-2222.
Letsinger et al., "Cholesteryl-conjugated oligonucleotides: Synthesis, properties, and activity as inhibitors of replication of human immunodeficiency virus in cell culture" PNAS (1989) 86:6553-6556.
Leumann et al., "DNA Analogues: From Supramolecular Principles to Biological Properties" Bioorganic & Medicinal Chemistry (2002) 10:841-854.
Maher et al., "Comparative hybrid arrest by tandem antisense oligodeoxyribonucleotides or oligodeoxyribonucleoside methylpbosphonates in a cell-free system" Nucl. Acid. Res. (1988) 16(8):3341-3358.
Manoharan et al., "Chemical Modifications to Improve Uptake and Bioavailability of Antisense Oligonucleotides" Ann. N.Y. Acad. Sci. (1992) 660: 306-309.
Manoharan et al., "Cholic Acid-Oligonucleotide Conjugates for Antisense Applications" Bioorg. Med. Chem. Lett. (1994) 4:1053-1060.
Manoharan et al., "Introduction of a Lipophilic Thioether Tether in the Minor Groove of Nucleic Acids for Antisense Applications" Bioorg. Med. Chem. Lett. (1993) 3(12):2765-2770.
Manoharan et al., "Lipidic Nucleic Acids" Tetrahedron Lett. (1995) 36(21):3651-3654.
Manoharan et al., "Oligonucleotide Conjugates: Alteration of the Pharmacokinetic Properties of Antisense Agents" Nucleosides & Nucleotides (1995) 14(3-5):969-973.
Martin, "New acces to 2'-O-alkylated ribonucleosides and properties of 2'-O-alkylated oligoribonucleotides" Helv. Chim. Acta. (1995) 78:486-504.
Meng et al., "Ube3a-ATS is an atypical RNA polymerase II transcript that represses the paternal expression of Ube3a" Hum. Mol. Genet. (2012) 21(13):3001-3012.
Meng et al., "Towards a therapy for Angelman Syndrome by Targeting a long-coding RNA" Nature (2015) 518:409-412.
Meng et al.,"Truncation of Ube3a-ATS Unsilences Paternal UBE3A and Ameliorates Behavioral Defects in the Angelman Syndrome Mouse Model" PLOS Genetics (2013) 9:e1004039.
Miller et al., "Phenotypic characterization of a genetically diverse panel of mice for behavioral despair and anxiety" PLoS One (2010) 5(12):e14458.
Mishra et al., "Improved leishmanicidal effect of phosphorotioate antisense oligonucleotides by LDL-mediated delivery" Biochim. Biophys. Acta (1995) 1264:229-237.
Modarresi et al., "Inhibition of natural antisense transcripts in vivo results in gene-specific transcriptional upregulation" Nat. Biotechnol. (2012) 30(5):453-459.
Morris et al., "Bidirectional transcription directs both transcriptional gene activation and suppression in human cells" PLoS Genet. (2008) 4(11):e1000258.
Nauwelaerts et al., "Cyclohexenyl nucleic acids: conformationally flexible oligonucleotides" Nucleic Acids Res. (2005) 33(8):2452-2463.
Nauwelaerts et al., "Structural characterization and biological evaluation of small interfering RNAs containing cyclohexenyl nucleosides" J. Am. Chem. Soc. (2007) 129(30):9340-9348.
New England Biolabs 1998/99 Catalog (cover page and pp. 121 and 284).
Njung'e et al., "Evaluation of marble-burying behavior as a model of anxiety" Pharmacol. Biochem. Behav. (1991) 38(1):63-67.
Oberhauser et al., "Effective incorporation of 2'-O-methyl-oligoribonucleotides into liposomes and enhanced cell association through modifications with thiocholesterol" Nucl. Acids Res. (1992) 20(3):533-538.
Orum et al., "Locked nucleic acids: A promising molecular family for gene-function analysis and antisense drug development" Curr. Opinion Mol. Ther. (2001) 3:239-243.

Pal-Bhadra et al., "Heterochromatic silencing and HP1 localization in Drosophila are dependent on the RNAi machinery" Science (2004) 303(5658):669-672.
Plagge "Non-Coding RNAs at the Gnas and Snrpn-Ube3a Imprinted Gene Loci and Their Involvement in Hereditary Disorders" Front Genet. (2012) 3: 1-6.
Powell et al., "R-loop formation at Snord116 mediates topotecan inhibition of Ube3a-antisense and allele-specific chromatin decondensation" Proc Natl Acad Sci (2013) 110: 13938-43.
Reynolds et al., "Rational siRNA design for RNA interference" Nature Biotechnology (2004) 22(3):326-330.
Robeyns et al., "Oligonucleotides with cyclohexene-nucleoside building blocks: crystallization and preliminary X-ray studies of a left-handed sequence GTGTACAC" Acta. Crystallogr. Sect. F. Struct. Biol. Cryst. Commun. (2005) 61(Pt 6):585-586.
Robeyns et al., "Structure of the fully modified left-handed cyclohexene nucleic acid sequence GTGTACAC" J. Am. Chem. Soc. (2008) 130(6):1979-1984.
Runte et al., "The IC-SNURF-SNRPN Transcript serves as a Host for Multiple Small Nucleolar RNA Species and as an Antisense RNA for UBE3A" Human Molecular Genetics (2001) 10: 2687-2700.
Sahoo et al., "Prader-Willi phenotype caused by paternal deficiency for the HBII-85 C/D box small nucleolar RNA cluster" Nat. Genet. (2008) 40(6):719-721.
Saison-Behmoaras et al., "Short modified antisense oligonucleotides directed against Ha-ras point mutation induce selective cleavage of the mRNA and inhibit T24 cells proliferation" EMBO J. (1991) 10(5):1111-1118.
Sanghvi et al., "Heterocyclic Base Modifications in Nucleic Acids and Their Applications in Antisense Oligonucleotides" Antisense Research and Applications (1993) pp. 273-288.
Shea et al., "Synthesis, hybridization properties and antiviral activity of lipid-oligodeoxynucleotide conjugates" Nucl. Acids Res. (1990) 18(13):3777-3783.
Singh et al., "LNA (locked nucleic acids): synthesis and high-affinity nucleic acid recognition" Chem. Commun. (1998) 455-456.
Singh et al., "Synthesis of 2'-amino-LNA: A novel conformationally restricted high-affinity oligonucleotide analogue with a handle" J. Org. Chem. (1998) 63: 10035-10039.
Smith et al., "Comparison of biosequences" Adv. Appl. Math. (1981) 2(4):482-489.
Srivastava et al., "Five—and Six-Membered Conformationally Locked 2',4'-Carbocyclic ribo-Thymidines: Synthesis, Structure, and Biochemical Studies" J. Am. Chem. Soc. (2007) 129(26):8362-8379.
Svinarchuk et al., "Inhibition of HIV proliferation in MT-4 cells by antisense oligonucleotide conjugated to lipophilic groups" Biochimie (1993) 75:49-54.
Tsai et al., "Paternal deletion from Snrpn to Ube3a in the mouse causes hypotonia, growth retardation and partial lethality and provides evidence for a gene contributing to Prader-Willi syndrome" Hum. Mol. Genet. (1999) 8(8):1357-1364.
Verbeure et al., "RNase H mediated cleavage of RNA by cyclohexene nucleic acid (CeNA)" Nucleic Acids Res. (2001) 29(24):4941-4947.
Verdel et al., "RNAi-mediated targeting of heterochromatin by the RITS complex" Science (2004) 303(5668):672-676.
Volpe et al., "Regulation of heterochromatic silencing and histone H3 lysine-9 methylation by RNAi" Science (2002) 297(5588):1833:1837.
Wahlestedt et al., "Potent and nontoxic antisense oligonucleotide containing locked nucleic acids" Proc. Natl. Acad. Sci. USA (2000) 97: 5633-5638.
Wang et al., "A straightforward stereoselective synthesis of D- and L-5-hydroxymethyl-2-cyclohexenylguanine" J. Org. Chem. (2001) 66(25):8478-8482.
Wang et al., "Cyclohexene nucleic acids (CeNA) form stable duplexes with RNA and induce RNase H activity" Nucleosides Nucleotides Nucleic Acids (2001) 20(4-7):785-788.
Wang et al., "Cyclohexene Nucleic Acids (CeNA): Serum Stable Oligonucleotides that Activate RNase H and Increase Duplex Stability with Complementary RNA" J. Am. Chem. Soc. (2000) 122(36):8595-8602.

(56) References Cited

OTHER PUBLICATIONS

Wang et al., "Stereocontrolled synthesis of ara-type cyclohexenyl nucleosides" J. Org. Chem. (2003) 68(11):4499-4505.

Williams et al., "Clinical and genetic aspects of Angelman syndrome" Genet. Med. (2010) 12(7):385-395.

Woolf et al., "Specificity of antisense oligonucleotides in vivo" Proc. Natl. Acad. Sci. (1992) 89(16):7305-7309.

Zhang et al., "PowerBLAST: A New Network BLAST Application for Interactive or Automated Sequence Analysis and Annotation" Genome Res. (1997) 7:649-656.

Zhou et al., "Fine Tuning of Electrostatics around the Internucleotidic Phosphate through Incorporation of Modified 2',4'-Carbocyclic-LNAs and—ENAs Leads to Significant Modulation of Antisense Properties" J. Org. Chem. (2009) 74:118-134.

International Search report for application EP 2864479 dated May 10, 2016.

International Search Report for application PCT/US2013/47701 dated Feb. 14, 2014.

International Search Report for application PCT/US2015/062622 dated Jan. 15, 2016.

MODULATION OF UBE3A-ATS EXPRESSION

SEQUENCE LISTING

The present application is being filed along with a Sequence Listing in electronic format. The Sequence Listing is provided as a file entitled BIOL0260USASEQ_ST25.txt created May 19, 2017 which is approximately 1.51 MB in size. The information in the electronic format of the sequence listing is incorporated herein by reference in its entirety.

FIELD

Certain embodiments are directed to methods and compounds for inhibiting UBE3A-ATS, the endogenous antisense transcript of ubiquitin protein ligase E3A (UBE3A). Such methods and compounds are useful for inducing expression of paternal UBE3A in cells and animals.

BACKGROUND

UBE3A is maternally expressed in neurons and encodes an E3 ubiquitin ligase named E6-AP. An endogenous antisense transcript of UBE3A, termed UBE3A-ATS, has been identified in humans and mice. UBE3A-ATS functions to suppress paternal Ube3a expression. (Meng et al., Hum Mol Genet. 21:3001-12, 2012).

Angelman syndrome (AS) is a neurodevelopmental disorder mostly attributed to deficiency of maternal UBE3A at 15q11.2, whereas paternal UBE3A is subject to genomic imprinting and silencing in neurons. Patients of Angelman syndrome suffer from developmental delay, speech impairment and seizures. Therapies for Angelman syndrome are limited and mainly focus on symptomatic management. (Williams, C. A. et al., Genet. Med., 12: 385-395, 2010).

Recently, topoisomerase inhibitors currently used in cancer treatment were found to "unsilence" paternal Ube3a expression in both a neuronal culture system and mice. (Huang, H. S. et al., Nature, 481: 185-189, 2012). However, the exact mechanism of unsilencing paternal Ube3a expression remains unknown and topoisomerase inhibitors are fraught with safety concerns because they are known to be non-specific and capable of inducing DNA damage, such as single and double-strand breaks.

Antisense technology is an effective means for modulating the expression of one or more specific gene products and can therefore prove to be uniquely useful in a number of therapeutic, diagnostic, and research applications. Chemically modified nucleosides may be incorporated into antisense compounds to enhance one or more properties, such as nuclease resistance, pharmacokinetics or affinity for a target nucleic acid. In 1998, the antisense compound, Vitravene® (fomivirsen; developed by Isis Pharmaceuticals Inc., Carlsbad, Calif.) was the first antisense drug to achieve marketing clearance from the U.S. Food and Drug Administration (FDA), and is currently a treatment of cytomegalovirus (CMV)-induced retinitis in AIDS patients. For another example, an antisense oligonucleotide targeting ApoB, KYNAMRO™, has been approved by the U.S. Food and Drug Administration (FDA) as an adjunct treatment to lipid-lowering medications and diet to reduce low density lipoprotein-cholesterol (LDL-C), ApoB, total cholesterol (TC), and non-high density lipoprotein-cholesterol (non HDL-C) in patients with homozygous familial hypercholesterolemia (HoFH).

SUMMARY

Several embodiments provided herein relate to the discovery that antisense compounds targeting UBE3A-ATS induce paternal expression of UBE3A. Several embodiments are drawn to methods and compounds for inducing paternal expression of UBE3A using antisense compounds targeting UBE3A-ATS within a region of UBE3A-ATS that includes the sequence of the small nucleolar RNA (snoRNA), HBII-85 (also referred to as SNORD116).

In certain embodiments, a compound consists of the nucleobase sequence and motif of ISIS No. 705095. In certain embodiments, a compound consists of the nucleobase sequence and motif of ISIS No. 705096. In certain embodiments, a compound consists of the nucleobase sequence and motif of ISIS No. 705097. In certain embodiments, a compound consists of the nucleobase sequence and motif of ISIS No. 705098. In certain embodiments, a compound consists of the nucleobase sequence and motif of ISIS No. 705099. In certain embodiments, a compound consists of the nucleobase sequence and motif of ISIS No. 705100. In certain embodiments, a compound consists of the nucleobase sequence and motif of ISIS No. 705101. In certain embodiments, a compound consists of the nucleobase sequence and motif of ISIS No. 705119. In certain embodiments, a compound consists of the nucleobase sequence and motif of ISIS No. 705120. In certain embodiments, a compound consists of the nucleobase sequence and motif of ISIS No. 705121. In certain embodiments, a compound consists of the nucleobase sequence and motif of ISIS No. 705122.

The present disclosure provides the following non-limiting numbered embodiments:

Embodiment 1

A method of inducing expression of paternal UBE3A in a cell comprising contacting the cell with an antisense compound targeted to a region of UBE3A-ATS that contains the pre-mRNA for SNORD116.

Embodiment 2

The method of embodiment 1, wherein UBE3A-ATS comprises a nucleic acid sequence at least 85% identical to SEQ ID NO: 1.

Embodiment 3

The method of any one of embodiments 1-2, wherein UBE3A-ATS comprises a nucleic acid sequence at least 85% identical to SEQ ID NO: 1 and the region of UBE3A-ATS consists of nucleobases at least 85% identical to nucleobases 545131 to 776518 of SEQ ID NO: 1.

Embodiment 4

A method of inducing expression of paternal UBE3A in an animal comprising administering to the animal an antisense compound targeted to UBE3A-ATS that contains the pre-mRNA for SNORD116.

Embodiment 5

The method of embodiment 24, wherein UBE3A-ATS comprises a nucleic acid sequence at least 85% identical to SEQ ID NO: 1.

Embodiment 6

The method of any one of embodiments 4-5, wherein UBE3A-ATS comprises a nucleic acid sequence at least 85% identical to SEQ ID NO: 1 and the region of UBE3A-ATS consists of nucleobases at least 85% identical to nucleobases 545131 to 776518 of SEQ ID NO: 1.

Embodiment 7

The method of any one of embodiments 1-6, wherein the antisense compound comprises an oligonucleotide consisting of 12 to 30 linked nucleosides, wherein the oligonucleotide is at least 85% complementary to a UBE3A-ATS nucleic acid sequence that contains the pre-mRNA for SNORD116.

Embodiment 8

The method of embodiment 7, wherein the oligonucleotide is at least 90% complementary over its entire length to an equal length region of a UBE3A-ATS nucleic acid sequence.

Embodiment 9

The method of embodiment 7, wherein the oligonucleotide is at least 95% complementary over its entire length to an equal length region of a UBE3A-ATS nucleic acid sequence.

Embodiment 10

The method of embodiment 7, wherein the oligonucleotide is 100% complementary over its entire length to an equal length region of a UBE3A-ATS nucleic acid sequence.

Embodiment 11

The method of any one of embodiments 1-10, wherein the antisense compound or oligonucleotide is a single-stranded oligonucleotide.

Embodiment 12

The method of any one of embodiments 7-11, wherein the oligonucleotide is a modified oligonucleotide.

Embodiment 13

The method of embodiment 12, wherein the modified oligonucleotide comprises at least one modified internucleoside linkage.

Embodiment 14

The method of embodiment 13, wherein the modified internucleoside linkage is a phosphorothioate internucleoside linkage.

Embodiment 15

The method of any one of embodiments 12-14, wherein at least one nucleoside comprises a modified sugar.

Embodiment 16

The method of embodiment 15, wherein the modified sugar is a bicyclic sugar comprising a bridge between the 4' and the 2' positions of the sugar.

Embodiment 17

The method of embodiment 16, wherein the bridge is selected from 4'-CH(CH$_3$)—O-2', 4'-CH$_2$-2', 4'-(CH$_2$)$_2$-2', 4'-CH$_2$—O-2', 4'-(CH$_2$)$_2$—O-2', 4'-CH$_2$—O—N(R$_1$)-2' and 4'-CH2-N(R$_1$)—O-2'- wherein each R1 is, independently, H, a protecting group or C1-C12 alkyl.

Embodiment 18

The method of embodiment 16, wherein the bridge is 4'-CH(CH$_3$)—O-2'.

Embodiment 19

The method of embodiment 16, wherein the bridge is selected from 4'-CH$_2$—O-2' and 4'-(CH$_2$)$_2$—O-2'.

Embodiment 20

The method of embodiment 16, wherein the modified sugar comprises a 2'-O-methoxyethyl group.

Embodiment 21

The method of any one of embodiments 12-20, wherein at least one nucleoside comprises a modified nucleobase.

Embodiment 22

The method of embodiment 21, wherein the modified nucleobase is a 5-methylcytosine.

Embodiment 23

The method of any one of embodiments 1-22, wherein the antisense compound or modified oligonucleotide induces expression of paternal UBE3A by at least 20%.

Embodiment 24

The method of any one of embodiments 1-22, wherein the antisense compound or modified oligonucleotide induces expression of paternal UBE3A by at least 30%.

Embodiment 25

The method of any one of embodiments 1-22, wherein the antisense compound or modified oligonucleotide induces expression of paternal UBE3A by at least 40%.

Embodiment 26

The method of any one of embodiments 1-22, wherein the antisense compound or modified oligonucleotide induces expression of paternal UBE3A by at least 50%.

Embodiment 27

The method of any one of embodiments 1-22, wherein the antisense compound or modified oligonucleotide induces expression of paternal UBE3A by at least 60%.

Embodiment 28

The method of any one of embodiments 1-22, wherein the antisense compound or modified oligonucleotide induces expression of paternal UBE3A by at least 70%.

Embodiment 29

The method of any one of embodiments 1-22, wherein the antisense compound or modified oligonucleotide induces expression of paternal UBE3A by at least 80%.

Embodiment 30

The method of any one of embodiments 1-22, wherein the antisense compound or modified oligonucleotide induces expression of paternal UBE3A by at least 90%.

Embodiment 31

The method of any one of embodiments 1-22, wherein the antisense compound or modified oligonucleotide induces expression of paternal UBE3A by at least 100%.

Embodiment 32

The method of any one of embodiments 1-22, wherein the antisense compound or modified oligonucleotide induces expression of paternal UBE3A by at least 110%.

Embodiment 33

The method of any one of embodiments 1-22, wherein the antisense compound or modified oligonucleotide induces expression of paternal UBE3A by at least 120%.

Embodiment 34

The method of any one of embodiments 1-22, wherein the antisense compound or modified oligonucleotide induces expression of paternal UBE3A by at least 130%.

Embodiment 35

The method of any one of embodiments 1-22, wherein the antisense compound or modified oligonucleotide induces expression of paternal UBE3A by at least 140%.

Embodiment 36

The method of any one of embodiments 1-22, wherein the antisense compound or modified oligonucleotide induces expression of paternal UBE3A by at least 150%.

Embodiment 37

The method of any one of embodiments 1-22, wherein the antisense compound or modified oligonucleotide induces expression of paternal UBE3A by at least 160%.

Embodiment 38

The method of any one of embodiments 1-22, wherein the antisense compound or modified oligonucleotide induces expression of paternal UBE3A by at least 170%.

Embodiment 39

The method of any one of embodiments 1-22, wherein the antisense compound or modified oligonucleotide induces expression of paternal UBE3A by at least 180%.

Embodiment 40

The method of any one of embodiments 1-22, wherein the antisense compound or modified oligonucleotide induces expression of paternal UBE3A by at least 190%.

Embodiment 41

The method of any one of embodiments 1-22, wherein the antisense compound or modified oligonucleotide induces expression of paternal UBE3A by at least 200%.

Embodiment 42

The method of any one of embodiments 1-22, wherein the antisense compound or modified oligonucleotide induces expression of paternal UBE3A by at least 210%.

Embodiment 43

The method of any one of embodiments 1-22, wherein the antisense compound or modified oligonucleotide induces expression of paternal UBE3A by at least 220%.

Embodiment 44

The method of any one of embodiments 1-22, wherein the antisense compound or modified oligonucleotide induces expression of paternal UBE3A by at least 230%.

Embodiment 45

The method of any one of embodiments 1-22, wherein the antisense compound or modified oligonucleotide induces expression of paternal UBE3A by at least 240%.

Embodiment 46

The method of any one of embodiments 1-22, wherein the antisense compound or modified oligonucleotide induces expression of paternal UBE3A by at least 250%.

Embodiment 47

A method of treating an animal with an antisense compound targeted to UBE3A-ATS comprising selecting an animal in need thereof and administering to the animal an antisense compound targeted to UBE3A-ATS that contains the pre-mRNA for SNORD116.

Embodiment 48

The method of embodiment 47, wherein UBE3A-ATS comprises a nucleic acid sequence at least 85% identical to SEQ ID NO: 1.

Embodiment 49

The method of embodiment 48, wherein UBE3A-ATS comprises a nucleic acid sequence at least 85% identical to nucleobases 545131 to 776518 of SEQ ID NO: 1.

Embodiment 50

The method of any one of embodiments 47-49, wherein the animal has Angelman Syndrome.

Embodiment 51

A compound comprising an antisense compound targeted to a region of UBE3A-ATS that contains the pre-mRNA for SNORD116.

Embodiment 52

The compound of embodiment 51, wherein UBE3A-ATS comprises a nucleic acid sequence at least 85% identical to SEQ ID NO: 1.

Embodiment 53

The compound of embodiment 51, wherein antisense compound is targeted to a region that comprises a nucleic acid sequence at least 85% identical to nucleobases 545131 to 776518 of SEQ ID NO: 1.

Embodiment 54

The compound of embodiment 52 or 53, wherein the oligonucleotide is at least 90% complementary over its entire length to an equal length region of a UBE3A-ATS nucleic acid sequence.

Embodiment 55

The compound of embodiment 52 or 53, wherein the oligonucleotide is at least 95% complementary over its entire length to an equal length region of a UBE3A-ATS nucleic acid sequence.

Embodiment 56

The compound of embodiment 52 or 53, wherein the oligonucleotide is 100% complementary over its entire length to an equal length region of a UBE3A-ATS nucleic acid sequence.

Embodiment 57

The compound of any one of embodiments 51-56, wherein the antisense compound or oligonucleotide is a single-stranded oligonucleotide.

Embodiment 58

The compound of any one of embodiments 51-57, wherein the oligonucleotide is a modified oligonucleotide.

Embodiment 59

The compound of embodiment 58, wherein the modified oligonucleotide comprises at least one modified internucleoside linkage.

Embodiment 60

The compound of embodiment 59, wherein the modified internucleoside linkage is a phosphorothioate internucleoside linkage.

Embodiment 61

The compound of any one of embodiments 58-60, wherein at least one nucleoside comprises a modified sugar.

Embodiment 62

The compound of embodiment 61, wherein the modified sugar is a bicyclic sugar comprising a bridge between the 4' and the 2' positions of the sugar.

Embodiment 63

The compound of embodiment 62, wherein the bridge is selected from 4'-CH(CH$_3$)—O-2', 4'-CH$_2$-2', 4'-(CH$_2$)$_2$-2', 4'-CH$_2$—O-2', 4'-(CH$_2$)$_2$—O-2', 4'-CH$_2$—O—N(R$_1$)-2' and 4'-CH2-N(R$_1$)—O-2'- wherein each R1 is, independently, H, a protecting group or C1-C12 alkyl.

Embodiment 64

The compound of embodiment 62, wherein the bridge is 4'-CH(CH$_3$)—O-2'.

Embodiment 65

The compound of embodiment 62, wherein the bridge is selected from 4'-CH$_2$—O-2' and 4'-(CH$_2$)$_2$—O-2'.

Embodiment 66

The compound of embodiment 63, wherein the modified sugar comprises a 2'-O-methoxyethyl group.

Embodiment 67

The compound of any one of embodiments 58-66, wherein at least one nucleoside comprises a modified nucleobase.

Embodiment 68

The compound of embodiment 67, wherein the modified nucleobase is a 5-methylcytosine.

Embodiment 69

The compound of any one of embodiments 51-68, wherein the antisense compound or modified oligonucleotide is capable of inducing expression of paternal UBE3A by at least 20%.

Embodiment 70

The compound of any one of embodiments 51-68, wherein the antisense compound or modified oligonucleotide is capable of inducing expression of paternal UBE3A by at least 30%.

Embodiment 71

The compound of any one of embodiments 51-68, wherein the antisense compound or modified oligonucleotide is capable of inducing expression of paternal UBE3A by at least 40%.

Embodiment 72

The compound of any one of embodiments 51-68, wherein the antisense compound or modified oligonucleotide is capable of inducing expression of paternal UBE3A by at least 50%.

Embodiment 73

The compound of any one of embodiments 51-68, wherein the antisense compound or modified oligonucleotide is capable of inducing expression of paternal UBE3A by at least 60%.

Embodiment 74

The compound of any one of embodiments 51-68, wherein the antisense compound or modified oligonucleotide is capable of inducing expression of paternal UBE3A by at least 70%.

Embodiment 75

The compound of any one of embodiments 51-68, wherein the antisense compound or modified oligonucleotide is capable of inducing expression of paternal UBE3A by at least 80%.

Embodiment 76

The compound of any one of embodiments 51-68, wherein the antisense compound or modified oligonucleotide is capable of inducing expression of paternal UBE3A by at least 90%.

Embodiment 77

The compound of any one of embodiments 51-68, wherein the antisense compound or modified oligonucleotide is capable of inducing expression of paternal UBE3A by at least 100%.

Embodiment 78

The compound of any one of embodiments 51-68, wherein the antisense compound or modified oligonucleotide is capable of inducing expression of paternal UBE3A by at least 110%.

Embodiment 79

The compound of any one of embodiments 51-68, wherein the antisense compound or modified oligonucleotide is capable of inducing expression of paternal UBE3A by at least 120%.

Embodiment 80

The compound of any one of embodiments 51-68, wherein the antisense compound or modified oligonucleotide is capable of inducing expression of paternal UBE3A by at least 130%.

Embodiment 81

The compound of any one of embodiments 51-68, wherein the antisense compound or modified oligonucleotide is capable of inducing expression of paternal UBE3A by at least 140%.

Embodiment 82

The compound of any one of embodiments 51-68, wherein the antisense compound or modified oligonucleotide is capable of inducing expression of paternal UBE3A by at least 150%.

Embodiment 83

The compound of any one of embodiments 51-68, wherein the antisense compound or modified oligonucleotide is capable of inducing expression of paternal UBE3A by at least 160%.

Embodiment 84

The compound of any one of embodiments 51-68, wherein the antisense compound or modified oligonucleotide is capable of inducing expression of paternal UBE3A by at least 170%.

Embodiment 85

The compound of any one of embodiments 51-68, wherein the antisense compound or modified oligonucleotide is capable of inducing expression of paternal UBE3A by at least 180%.

Embodiment 86

The compound of any one of embodiments 51-68, wherein the antisense compound or modified oligonucleotide is capable of inducing expression of paternal UBE3A by at least 190%.

Embodiment 87

The compound of any one of embodiments 51-68, wherein the antisense compound or modified oligonucleotide is capable of inducing expression of paternal UBE3A by at least 200%.

Embodiment 88

The compound of any one of embodiments 51-68, wherein the antisense compound or modified oligonucleotide is capable of inducing expression of paternal UBE3A by at least 210%.

Embodiment 89

The compound of any one of embodiments 51-68, wherein the antisense compound or modified oligonucleotide is capable of inducing expression of paternal UBE3A by at least 220%.

Embodiment 90

The compound of any one of embodiments 51-68, wherein the antisense compound or modified oligonucleotide is capable of inducing expression of paternal UBE3A by at least 230%.

Embodiment 91

The compound of any one of embodiments 51-68, wherein the antisense compound or modified oligonucleotide is capable of inducing expression of paternal UBE3A by at least 240%.

Embodiment 92

The compound of any one of embodiments 51-68, wherein the antisense compound or modified oligonucleotide is capable of inducing expression of paternal UBE3A by at least 250%.

Embodiment 93

A method of reducing UBE3A-ATS in a cell comprising contacting the cell with the compound of any of embodiments 51 to 92.

Embodiment 94

A method comprising administering to a cell or animal an antisense compound targeted to UBE3A-ATS that contains the pre-mRNA for SNORD116, wherein expression of paternal UBE3A is induced.

Embodiment 95

The method of embodiment 94, wherein UBE3A-ATS comprises a nucleic acid sequence at least 85% identical to SEQ ID NO: 1.

Embodiment 96

The method of any one of embodiments 94-95, wherein UBE3A-ATS comprises a nucleic acid sequence at least 85% identical to SEQ ID NO: 1 and the region of UBE3A-ATS consists of nucleobases at least 85% identical to nucleobases 545131 to 776518 of SEQ ID NO: 1.

Embodiment 97

The method of any one of embodiments 94-96, wherein the antisense compound comprises an oligonucleotide consisting of 12 to 30 linked nucleosides, wherein the oligonucleotide is at least 85% complementary to a UBE3A-ATS nucleic acid sequence that contains the pre-mRNA for SNORD116.

Embodiment 98

The method of embodiment 97, wherein the oligonucleotide is at least 90%, at least 95%, or 100% complementary over its entire length to an equal length region of a UBE3A-ATS nucleic acid sequence.

Embodiment 99

The method of any one of embodiments 94-98, wherein the antisense compound or oligonucleotide is a single-stranded oligonucleotide.

Embodiment 100

The method of any one of embodiments 97-99, wherein the oligonucleotide is a modified oligonucleotide.

Embodiment 101

The method of embodiment 100, wherein the modified oligonucleotide comprises at least one modified internucleoside linkage.

Embodiment 102

The method of embodiment 101, wherein the modified internucleoside linkage is a phosphorothioate internucleoside linkage.

Embodiment 103

The method of any one of embodiments 97-102, wherein at least one nucleoside comprises a modified sugar.

Embodiment 104

The method of embodiment 103, wherein the modified sugar is a bicyclic sugar comprising a bridge between the 4' and the 2' positions of the sugar.

Embodiment 105

The method of embodiment 104, wherein the bridge is selected from 4'-CH(CH$_3$)—O-2', 4'-CH$_2$-2', 4'-(CH$_2$)$_2$-2', 4'-CH$_2$—O-2', 4'-(CH$_2$)$_2$—O-2', 4'-CH$_2$—O—N(R$_1$)-2' and 4'-CH2-N(R$_1$)—O-2'- wherein each R1 is, independently, H, a protecting group or C1-C12 alkyl.

Embodiment 106

The method of embodiment 105, wherein the bridge is 4'-CH(CH$_3$)—O-2'.

Embodiment 107

The method of embodiment 105, wherein the bridge is selected from 4'-CH$_2$—O-2' and 4'-(CH$_2$)$_2$—O-2'.

Embodiment 108

The method of embodiment 103, wherein the modified sugar comprises a 2'-O-methoxyethyl group.

Embodiment 109

The method of any one of embodiments 97-108, wherein at least one nucleoside comprises a modified nucleobase.

Embodiment 110

The method of embodiment 109, wherein the modified nucleobase is a 5-methylcytosine.

Embodiment 111

The method of any one of embodiments 94-110, wherein the antisense compound or modified oligonucleotide induces expression of paternal UBE3A by at least 20%.

Embodiment 112

The compound of any one of embodiments 51-68, wherein the antisense compound or modified oligonucleotide is capable of inducing expression of paternal UBE3A by at least 30%.

Embodiment 113

The compound of any one of embodiments 51-68, wherein the antisense compound or modified oligonucleotide is capable of inducing expression of paternal UBE3A by at least 40%.

Embodiment 114

The compound of any one of embodiments 51-68, wherein the antisense compound or modified oligonucleotide is capable of inducing expression of paternal UBE3A by at least 50%.

Embodiment 115

The compound of any one of embodiments 51-68, wherein the antisense compound or modified oligonucleotide is capable of inducing expression of paternal UBE3A by at least 60%.

Embodiment 116

The compound of any one of embodiments 51-68, wherein the antisense compound or modified oligonucleotide is capable of inducing expression of paternal UBE3A by at least 70%.

Embodiment 117

The compound of any one of embodiments 51-68, wherein the antisense compound or modified oligonucleotide is capable of inducing expression of paternal UBE3A by at least 80%.

Embodiment 118

The compound of any one of embodiments 51-68, wherein the antisense compound or modified oligonucleotide is capable of inducing expression of paternal UBE3A by at least 90%.

Embodiment 119

The compound of any one of embodiments 51-68, wherein the antisense compound or modified oligonucleotide is capable of inducing expression of paternal UBE3A by at least 100%.

Embodiment 120

The compound of any one of embodiments 51-68, wherein the antisense compound or modified oligonucleotide is capable of inducing expression of paternal UBE3A by at least 110%.

Embodiment 121

The compound of any one of embodiments 51-68, wherein the antisense compound or modified oligonucleotide is capable of inducing expression of paternal UBE3A by at least 120%.

Embodiment 122

The compound of any one of embodiments 51-68, wherein the antisense compound or modified oligonucleotide is capable of inducing expression of paternal UBE3A by at least 130%.

Embodiment 123

The compound of any one of embodiments 51-68, wherein the antisense compound or modified oligonucleotide is capable of inducing expression of paternal UBE3A by at least 140%.

Embodiment 124

The compound of any one of embodiments 51-68, wherein the antisense compound or modified oligonucleotide is capable of inducing expression of paternal UBE3A by at least 150%.

Embodiment 125

The compound of any one of embodiments 51-68, wherein the antisense compound or modified oligonucleotide is capable of inducing expression of paternal UBE3A by at least 160%.

Embodiment 126

The compound of any one of embodiments 51-68, wherein the antisense compound or modified oligonucleotide is capable of inducing expression of paternal UBE3A by at least 170%.

Embodiment 127

The compound of any one of embodiments 51-68, wherein the antisense compound or modified oligonucleotide is capable of inducing expression of paternal UBE3A by at least 180%.

Embodiment 128

The compound of any one of embodiments 51-68, wherein the antisense compound or modified oligonucleotide is capable of inducing expression of paternal UBE3A by at least 190%.

Embodiment 129

The compound of any one of embodiments 51-68, wherein the antisense compound or modified oligonucleotide is capable of inducing expression of paternal UBE3A by at least 200%.

Embodiment 130

The compound of any one of embodiments 51-68, wherein the antisense compound or modified oligonucleotide is capable of inducing expression of paternal UBE3A by at least 210%.

Embodiment 131

The compound of any one of embodiments 51-68, wherein the antisense compound or modified oligonucleotide is capable of inducing expression of paternal UBE3A by at least 220%.

Embodiment 132

The compound of any one of embodiments 51-68, wherein the antisense compound or modified oligonucleotide is capable of inducing expression of paternal UBE3A by at least 230%.

Embodiment 133

The compound of any one of embodiments 51-68, wherein the antisense compound or modified oligonucleotide is capable of inducing expression of paternal UBE3A by at least 240%.

Embodiment 134

The compound of any one of embodiments 51-68, wherein the antisense compound or modified oligonucleotide is capable of inducing expression of paternal UBE3A by at least 250%.

DETAILED DESCRIPTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference for the portions of the document discussed herein, as well as in their entirety.

It is understood that the sequence set forth in each SEQ ID NO described herein is independent of any modification to a sugar moiety, an internucleoside linkage, or a nucleobase. As such, antisense compounds defined by a SEQ ID NO may comprise, independently, one or more modifications to a sugar moiety, an internucleoside linkage, or a nucleobase. Antisense compounds described by Isis Number (Isis No) indicate a combination of nucleobase sequence and motif.

Definitions

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Where permitted, all patents, applications, published applications and other publications, GENBANK Accession Numbers and associated sequence information obtainable through databases such as National Center for Biotechnology Information (NCBI) and other data referred to throughout in the disclosure herein are incorporated by reference for the portions of the document discussed herein, as well as in their entirety.

Unless otherwise indicated, the following terms have the following meanings:

"2'-O-methoxyethyl" (also 2'-MOE and 2'-O($CH_2$)$_2$—$OCH_3$) refers to an O-methoxy-ethyl modification at the 2' position of a furanose ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" means a nucleoside comprising a substituent at the 2'-position of the furanosyl ring other than H or OH. In certain embodiments, 2' substituted nucleosides include nucleosides with bicyclic sugar modifications.

"3' target site" refers to the nucleotide of a target nucleic acid which is complementary to the 3'-most nucleotide of a particular antisense compound.

"5' target site" refers to the nucleotide of a target nucleic acid which is complementary to the 5'-most nucleotide of a particular antisense compound.

"5-methylcytosine" means a cytosine modified with a methyl group attached to the 5 position. A 5-methylcytosine is a modified nucleobase.

"About" means within ±7% of a value. For example, if it is stated, "the compounds affected at least about 70% inhibition of UBE3A-ATS", it is implied that UBE3A-ATS levels are inhibited within a range of 63% and 77%. Similarly, if it is stated, "the compounds affected at least about 20% induction of paternal UBE3A expression", it is implied that UBE3A levels are induced by a range within 13% and 27%.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid.

"Antisense compound" means an oligomeric compound that is capable of undergoing hybridization to a target nucleic acid through hydrogen bonding. Examples of antisense compounds include single-stranded and double-stranded compounds, such as, antisense oligonucleotides, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means a single-stranded oligonucleotide having a nucleobase sequence that permits hybridization to a corresponding region or segment of a target nucleic acid.

"Base complementarity" refers to the capacity for the precise base pairing of nucleobases of an antisense oligonucleotide with corresponding nucleobases in a target nucleic acid (i.e., hybridization), and is mediated by Watson-Crick, Hoogsteen or reversed Hoogsteen hydrogen binding between corresponding nucleobases.

"Bicyclic sugar moiety" means a modified sugar moiety comprising a 4 to 7 membered ring (including but not limited to a furanosyl) comprising a bridge connecting two atoms of the 4 to 7 membered ring to form a second ring, resulting in a bicyclic structure. In certain embodiments, the 4 to 7 membered ring is a sugar ring. In certain embodiments the 4 to 7 membered ring is a furanosyl. In certain such embodiments, the bridge connects the 2'-carbon and the 4'-carbon of the furanosyl.

"Bicyclic nucleic acid" or "BNA" or "BNA nucleosides" means nucleic acid monomers having a bridge connecting two carbon atoms between the 4' and 2'position of the nucleoside sugar unit, thereby forming a bicyclic sugar. Examples of such bicyclic sugar include, but are not limited to A) α-L-Methyleneoxy (4'-CH$_2$—O-2') LNA, (B) β-D-Methyleneoxy (4'-CH$_2$—O-2') LNA, (C) Ethyleneoxy (4'-(CH$_2$)$_2$—O-2') LNA, (D) Aminooxy (4'-CH$_2$—O—N(R)-2') LNA and (E) Oxyamino (4'-CH$_2$—N(R)—O-2') LNA, as depicted below.

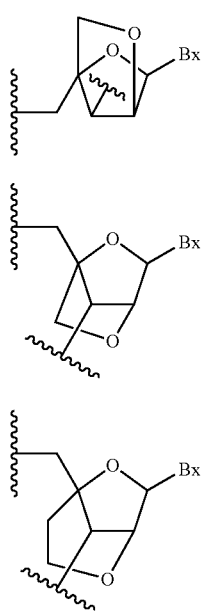

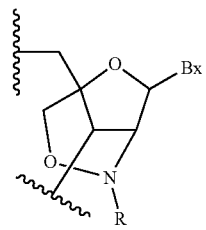

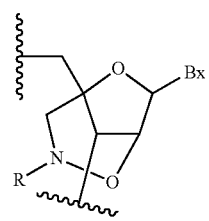

As used herein, LNA compounds include, but are not limited to, compounds having at least one bridge between the 4' and the 2' position of the sugar wherein each of the bridges independently comprises 1 or from 2 to 4 linked groups independently selected from —[C(R$_1$)(R$_2$)]$_n$—, —C(R$_1$)═C(R$_2$)—, —C(R$_1$)═N—, —C(═NR$_1$)—, —C(═O)—, —C(═S)—, —O—, —Si(R$_1$)$_2$—, —S(═O)$_x$— and —N(R$_1$)—; wherein: x is 0, 1, or 2; n is 1, 2, 3, or 4; each R$_1$ and R$_2$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, a heterocycle radical, a substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(═O)—H), substituted acyl, CN, sulfonyl (S(═O)$_2$-J$_1$), or sulfoxyl (S(═O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(═O)—H), substituted acyl, a heterocycle radical, a substituted heterocycle radical, C$_1$-C$_{12}$ aminoalkyl, substituted C$_1$-C$_{12}$ aminoalkyl or a protecting group.

Examples of 4'-2' bridging groups encompassed within the definition of LNA include, but are not limited to one of formulae: —[C(R$_1$)(R$_2$)]$_n$—, —[C(R$_1$)(R$_2$)]$_n$—O—, —C(R$_1$R$_2$)—N(R$_1$)—O— or —C(R$_1$R$_2$)—O—N(R$_1$)—. Furthermore, other bridging groups encompassed with the definition of LNA are 4'-CH$_2$-2', 4'-(CH$_2$)$_2$-2', 4'-(CH$_2$)$_3$-2', 4'-CH$_2$—O-2', 4'-(CH$_2$)$_2$—O-2', 4'-CH$_2$—O—N(R$_1$)-2' and 4'-CH$_2$—N(R$_1$)—O-2'- bridges, wherein each R$_1$ and R$_2$ is, independently, H, a protecting group or C$_1$-C$_{12}$ alkyl.

Also included within the definition of LNA according to the invention are LNAs in which the 2'-hydroxyl group of the ribosyl sugar ring is connected to the 4' carbon atom of the sugar ring, thereby forming a methyleneoxy (4'-CH$_2$—O-2') bridge to form the bicyclic sugar moiety. The bridge can also be a methylene (—CH$_2$—) group connecting the 2' oxygen atom and the 4' carbon atom, for which the term methyleneoxy (4'-CH$_2$—O-2') LNA is used. Furthermore; in the case of the bicyclic sugar moiety having an ethylene bridging group in this position, the term ethyleneoxy (4'-CH$_2$CH$_2$—O-2') LNA is used. α-L-methyleneoxy (4'-CH$_2$—O-2'), an isomer of methyleneoxy (4'-CH$_2$—O-2') LNA is also encompassed within the definition of LNA, as used herein.

"Cap structure" or "terminal cap moiety" means chemical modifications, which have been incorporated at either terminus of an antisense compound.

"cEt" or "constrained ethyl" means a bicyclic sugar moiety comprising a bridge connecting the 4'-carbon and the 2'-carbon, wherein the bridge has the formula: 4'-CH($CH_3$)—O-2'.

"Constrained ethyl nucleoside" (also cEt nucleoside) means a nucleoside comprising a bicyclic sugar moiety comprising a 4'-CH($CH_3$)—O-2' bridge.

"Chemically distinct region" refers to a region of an antisense compound that is in some way chemically different than another region of the same antisense compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Complementarity" means the capacity for pairing between nucleobases of a first nucleic acid and a second nucleic acid.

"Comply" means the adherence with a recommended therapy by an individual.

"Comprise," "comprises" and "comprising" will be understood to imply the inclusion of a stated step or element or group of steps or elements but not the exclusion of any other step or element or group of steps or elements.

"Contiguous nucleobases" means nucleobases immediately adjacent to each other.

"Deoxyribonucleotide" means a nucleotide having a hydrogen at the 2' position of the sugar portion of the nucleotide. Deoxyribonucleotides may be modified with any of a variety of substituents.

"Designing" or "Designed to" refer to the process of designing an oligomeric compound that specifically hybridizes with a selected nucleic acid molecule.

"Efficacy" means the ability to produce a desired effect.

"Expression" includes all the functions by which a gene's coded information is converted into structures present and operating in a cell. Such structures include, but are not limited to the products of transcription and translation.

"Fully complementary" or "100% complementary" means each nucleobase of a first nucleic acid has a complementary nucleobase in a second nucleic acid. In certain embodiments, a first nucleic acid is an antisense compound and a target nucleic acid is a second nucleic acid.

"Fully modified motif" refers to an antisense compound comprising a contiguous sequence of nucleosides wherein essentially each nucleoside is a sugar modified nucleoside having uniform modification.

"Gapmer" means a chimeric antisense compound in which an internal region having a plurality of nucleosides that support RNase H cleavage is positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Gap-widened" means an antisense compound having a gap segment of 12 or more contiguous 2'-deoxyribonucleotides positioned between 5' and 3' wing segments having from one to six nucleotides having modified sugar moieties.

"Hybridization" means the annealing of complementary nucleic acid molecules. In certain embodiments, complementary nucleic acid molecules include, but are not limited to, an antisense compound and a nucleic acid target. In certain embodiments, complementary nucleic acid molecules include, but are not limited to, an antisense oligonucleotide and a nucleic acid target.

"Immediately adjacent" means there are no intervening elements between the immediately adjacent elements.

"Individual" means a human or non-human animal selected for treatment or therapy.

"Induce", "inhibit", "potentiate", "elevate", "increase", "decrease", upregulate", "downregulate", or the like, generally denote quantitative differences between two states.

"Inhibiting the expression or activity" refers to a reduction, blockade of the expression or activity and does not necessarily indicate a total elimination of expression or activity.

"Internucleoside linkage" refers to the chemical bond between nucleosides.

"Lengthened" antisense oligonucleotides are those that have one or more additional nucleosides relative to an antisense oligonucleotide disclosed herein.

"Linked deoxynucleoside" means a nucleic acid base (A, G, C, T, U) substituted by deoxyribose linked by a phosphate ester to form a nucleotide.

"Linked nucleosides" means adjacent nucleosides linked together by an internucleoside linkage.

"Mismatch" or "non-complementary nucleobase" refers to the case when a nucleobase of a first nucleic acid is not capable of pairing with the corresponding nucleobase of a second or target nucleic acid.

"Modified internucleoside linkage" refers to a substitution or any change from a naturally occurring internucleoside bond (i.e. a phosphodiester internucleoside bond).

"Modified nucleobase" means any nucleobase other than adenine, cytosine, guanine, thymidine, or uracil. An "unmodified nucleobase" means the purine bases adenine (A) and guanine (G), and the pyrimidine bases thymine (T), cytosine (C) and uracil (U).

"Modified nucleoside" means a nucleoside having, independently, a modified sugar moiety and/or modified nucleobase.

"Modified nucleotide" means a nucleotide having, independently, a modified sugar moiety, modified internucleoside linkage, or modified nucleobase.

"Modified oligonucleotide" means an oligonucleotide comprising at least one modified internucleoside linkage, a modified sugar, and/or a modified nucleobase.

"Modified sugar" means substitution and/or any change from a natural sugar moiety.

"Monomer" refers to a single unit of an oligomer. Monomers include, but are not limited to, nucleosides and nucleotides, whether naturally occurring or modified.

"Motif" means the pattern of unmodified and modified nucleosides in an antisense compound.

"Natural sugar moiety" means a sugar moiety found in DNA (2'-H) or RNA (2'-OH).

"Naturally occurring internucleoside linkage" means a 3' to 5' phosphodiester linkage.

"Non-complementary nucleobase" refers to a pair of nucleobases that do not form hydrogen bonds with one another or otherwise support hybridization.

"Nucleic acid" refers to molecules composed of monomeric nucleotides. A nucleic acid includes, but is not limited to, ribonucleic acids (RNA), deoxyribonucleic acids (DNA), single-stranded nucleic acids, double-stranded nucleic acids, small interfering ribonucleic acids (siRNA), and microRNAs (miRNA).

"Nucleobase" means a heterocyclic moiety capable of pairing with a base of another nucleic acid.

"Nucleobase complementarity" refers to a nucleobase that is capable of base pairing with another nucleobase. For example, in DNA, adenine (A) is complementary to thymine (T). For example, in RNA, adenine (A) is complementary to uracil (U). In certain embodiments, complementary nucleobase refers to a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair.

"Nucleobase sequence" means the order of contiguous nucleobases independent of any sugar, linkage, and/or nucleobase modification.

"Nucleoside" means a nucleobase linked to a sugar.

"Nucleoside mimetic" includes those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo or tricyclo sugar mimetics, e.g., non furanose sugar units. Nucleotide mimetic includes those structures used to replace the nucleoside and the linkage at one or more positions of an oligomeric compound such as for example peptide nucleic acids or morpholinos (morpholinos linked by —N(H)—C(=O)—O— or other non-phosphodiester linkage). Sugar surrogate overlaps with the slightly broader term nucleoside mimetic but is intended to indicate replacement of the sugar unit (furanose ring) only. The tetrahydropyranyl rings provided herein are illustrative of an example of a sugar surrogate wherein the furanose sugar group has been replaced with a tetrahydropyranyl ring system. "Mimetic" refers to groups that are substituted for a sugar, a nucleobase, and/or internucleoside linkage. Generally, a mimetic is used in place of the sugar or sugar-internucleoside linkage combination, and the nucleobase is maintained for hybridization to a selected target.

"Nucleotide" means a nucleoside having a phosphate group covalently linked to the sugar portion of the nucleoside.

"Oligomeric compound" means a polymer of linked monomeric subunits which is capable of hybridizing to at least a region of a nucleic acid molecule.

"Oligonucleoside" means an oligonucleotide in which the internucleoside linkages do not contain a phosphorus atom.

"Oligonucleotide" means a polymer of linked nucleosides each of which can be modified or unmodified, independent one from another.

"Peptide" means a molecule formed by linking at least two amino acids by amide bonds. Without limitation, as used herein, "peptide" refers to polypeptides and proteins.

"Phosphorothioate linkage" means a linkage between nucleosides where the phosphodiester bond is modified by replacing one of the non-bridging oxygen atoms with a sulfur atom. A phosphorothioate linkage is a modified internucleoside linkage.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an antisense compound "Region" is defined as a portion of the target nucleic acid having at least one identifiable structure, function, or characteristic.

"Ribonucleotide" means a nucleotide having a hydroxy at the 2' position of the sugar portion of the nucleotide. Ribonucleotides may be modified with any of a variety of substituents.

"Segments" are defined as smaller or sub-portions of regions within a target nucleic acid.

"Sites," as used herein, are defined as unique nucleobase positions within a target nucleic acid.

"Specifically hybridizable" refers to an antisense compound having a sufficient degree of complementarity between an antisense oligonucleotide and a target nucleic acid to induce a desired effect, while exhibiting minimal or no effects on non-target nucleic acids under conditions in which specific binding is desired, i.e., under physiological conditions in the case of in vivo assays and therapeutic treatments. "Stringent hybridization conditions" or "stringent conditions" refer to conditions under which an oligomeric compound will hybridize to its target sequence, but to a minimal number of other sequences.

"Subject" means a human or non-human animal selected for treatment or therapy.

"Target" refers to a protein, the modulation of which is desired.

"Target gene" refers to a gene encoding a target.

"Targeting" means the process of design and selection of an antisense compound that will specifically hybridize to a target nucleic acid and induce a desired effect.

"Target nucleic acid," "target RNA," "target RNA transcript" and "nucleic acid target" all mean a nucleic acid capable of being targeted by antisense compounds.

"Target region" means a portion of a target nucleic acid to which one or more antisense compounds is targeted.

"Target segment" means the sequence of nucleotides of a target nucleic acid to which an antisense compound is targeted. "5' target site" refers to the 5'-most nucleotide of a target segment. "3' target site" refers to the 3'-most nucleotide of a target segment.

"UBE3A-ATS" and "Ube3A-ATS" can be used interchangeably without capitalization of their spelling referring to any particular species or ortholog.

"UBE3A" and "Ube3A" can be used interchangeably without capitalization of their spelling referring to any particular species or ortholog. Additionally, "UBE3A", "UBE3A", "Ube3A", and "Ube3A" can be used interchangeably without italization referring to nucleic acid or protein unless specifically indicated to the contrary.

"Unmodified" nucleobases mean the purine bases adenine (A) and guanine (G), and the pyrimidine bases thymine (T), cytosine (C) and uracil (U).

"Unmodified nucleotide" means a nucleotide composed of naturally occurring nucleobases, sugar moieties, and internucleoside linkages. In certain embodiments, an unmodified nucleotide is an RNA nucleotide (i.e. β-D-ribonucleosides) or a DNA nucleotide (i.e. β-D-deoxyribonucleoside).

"Validated target segment" is defined as at least an 8-nucleobase portion (i.e. 8 consecutive nucleobases) of a target region to which an antisense compound is targeted.

"Wing segment" means a plurality of nucleosides modified to impart to an oligonucleotide properties such as enhanced inhibitory activity, increased binding affinity for a target nucleic acid, or resistance to degradation by in vivo nucleases.

Certain Embodiments

Certain embodiments are drawn to a method of inducing expression of paternal UBE3A in a cell comprising contacting the cell with an antisense compound targeted to UBE3A-ATS. In several aspects, UBE3A-ATS comprises a nucleic acid sequence at least 85% identical to SEQ ID NO:1.

Several embodiments provide a method of inducing expression of paternal UBE3A in a cell comprising contacting the cell with an antisense compound targeted to a region of UBE3A-ATS that contains the pre-mRNA for SNORD116.

In certain embodiments, the present disclosure provides methods of inducing expression of paternal UBE3A in a cell comprising contacting the cell with an antisense compound targeted to a region of UBE3A-ATS that contains the pre-mRNA for SNORD116. Several embodiments are directed to a method of reducing UBE3A-ATS in a cell comprising contacting the cell with an antisense compound targeted to a region of UBE3A-ATS, wherein the region of UBE3A-ATS contains the pre-mRNA for SNORD116. In certain aspects, UBE3A-ATS comprises a nucleic acid sequence at least 85% identical to SEQ ID NO:1. In several aspects, contacting a cell with an antisense compound targeted to a region of UBE3A-ATS that contains the pre-mRNA for SNORD116, induces expression of paternal UBE3A and/or reduces UBE3A-ATS in the cell without reducing Snrpn and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

In several aspects of any of the foregoing embodiments, contacting the cell with the antisense compound reduces the level of UBE3A-ATS in the cell and/or induces expression of paternal UBE3A protein in the cell.

In several aspects of any of the foregoing embodiments, the cell is a cultured cell. In the same aspect, the cell is an animal.

Certain embodiments are drawn to a method of inducing expression of paternal UBE3A in an animal comprising administering to the animal an antisense compound targeted to UBE3A-ATS. In several aspects, UBE3A-ATS comprises a nucleic acid sequence at least 85% identical to SEQ ID NO:1.

Several embodiments relate to a method of inducing expression of paternal UBE3A and/or reducing UBE3A-ATS in an animal comprising administering to the animal an antisense compound targeted to a region of UBE3A-ATS that contains the pre-mRNA for SNORD116. In some aspects, UBE3A-ATS comprises a nucleic acid sequence at least 85% identical to SEQ ID NO:1.

In any of the aforementioned embodiments and aspects thereof, the antisense compound can comprise an oligonucleotide consisting of 12 to 30 linked nucleosides, wherein the oligonucleotide is at least 85% complementary to a UBE3A-ATS nucleic acid sequence. In certain aspects, the oligonucleotide is at least 90%, at least 95%, or 100% complementary over its entire length to an equal length region of a UBE3A-ATS nucleic acid sequence. In certain embodiments, the oligonucleotide is at least 90%, at least 95%, or 100% complementary over its entire length to an equal length region of a UBE3A-ATS nucleic acid sequence that contains the pre-mRNA for SNORD116. In certain aspects, the antisense compound or oligonucleotide is a single-stranded oligonucleotide. In several aspects, the oligonucleotide is a modified oligonucleotide. In the same aspect, the modified oligonucleotide can comprise at least one modified internucleoside linkage. Yet again in the same aspect, the modified internucleoside linkage can be a phosphorothioate internucleoside linkage. In several aspects, at least one nucleoside comprises a modified sugar. In the same aspect, the modified sugar is a bicyclic sugar comprising a bridge between the 4' and the 2' positions of the sugar, such as a bridge is selected from 4'-CH(CH$_3$)—O-2', 4'-CH$_2$-2', 4'-(CH$_2$)$_2$-2', 4'-CH$_2$—O-2', 4'-(CH$_2$)$_2$—O-2', 4'-CH$_2$—O—N(R$_1$)-2' and 4'-CH2-N(R$_1$)—O-2'- wherein each R1 is, independently, H, a protecting group or C1-C12 alkyl. Further in the same aspect, the bridge is 4'-CH(CH$_3$)—O-2'.

In any of the preceding embodiments and aspects thereof including a modified sugar, the modified sugar can comprise a 2'-O-methoxyethyl group.

In any of the preceding embodiments and aspects thereof including a modified oligonucleotide, at least one nucleoside can comprise a modified nucleobase, such as a 5-methylcytosine.

In any of the foregoing embodiments and aspects thereof, the antisense compound or modified oligonucleotide induces expression of paternal UBE3A by at least 20%, at least 30%, at least 40%, at least 50%, at least 60%, at least 70%, at least 80%, at least 90%, at least 100%, at least 110%, at least 120%, at least 130%, at least 140%, at least 150%, at least 160%, at least 170%, at least 180%, at least 190%, at least 200%, at least 210%, at least 220%, at least 230%, at least 240%, or at least 250%.

Certain embodiments are drawn to a method of treating an animal with an antisense compound targeted to UBE3A-ATS comprising selecting an animal in need thereof and administering to the animal an antisense compound targeted to UBE3A-ATS. In several aspects, UBE3A-ATS comprises a nucleic acid sequence at least 85% identical to SEQ ID NO: 1.

Several embodiments are directed to a method of treating an animal with an antisense compound targeted to UBE3A-ATS comprising selecting an animal in need thereof and administering to the animal an antisense compound targeted to a region of UBE3A-ATS that contains the pre-mRNA for SNORD116. In some aspects, UBE3A-ATS comprises a nucleic acid sequence at least 85% identical to SEQ ID NO: 1.

In certain aspects of any of the foregoing embodiments drawn to a method of treating an animal, the animal has Angelman Syndrome. In certain aspects, the animal having Angelman Syndrome treated according to the methods provided herein show an improvement in anxiety, learning, balance, motor function, and/or seizures.

In certain aspects of any of the foregoing embodiments drawn to a method of treating an animal, administering an antisense compound provided treats the animal without reducing levels of the neighboring small nucleolar RNAs (snoRNAs) Snrpn and/or MBII-52/HBII-52. In several aspects, administering an antisense compound provided herein treats the animal without reducing Snrpn and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Certain embodiments relate to a method of inducing expression of paternal UBE3A in a cell comprising contacting the cell with an antisense compound targeted to UBE3A-ATS within nucleotides 545131 to 776518 of SEQ ID NO: 1, wherein UBE3A-ATS comprises a nucleic acid sequence at least 85% identical to the sequence of SEQ ID NO:1.

Certain embodiments are drawn to an antisense compound targeted to UBE3A-ATS. In several aspects, UBE3A-ATS comprises a nucleic acid sequence at least 85% identical to SEQ ID NO: 1.

In several aspects of any of the foregoing embodiments, the antisense compound is capable of reducing the level of UBE3A-ATS in the cell and/or inducing expression of paternal UBE3A protein in the cell.

In any of the aforementioned embodiments and aspects thereof, the antisense compound can comprise an oligonucleotide consisting of 12 to 30 linked nucleosides, wherein the oligonucleotide is at least 85% complementary to a UBE3A-ATS nucleic acid sequence. In certain aspects, the oligonucleotide is at least 90%, at least 95%, or 100% complementary over its entire length to an equal length region of a UBE3A-ATS nucleic acid sequence. In any of the aforementioned embodiments and aspects thereof, the antisense compound can comprise an oligonucleotide consisting of 12 to 30 linked nucleosides, wherein the oligonucleotide is at least 85% complementary to a UBE3A-ATS nucleic acid sequence that contains the pre-mRNA for SNORD116. In certain aspects, the oligonucleotide is at least 90%, at least 95%, or 100% complementary over its entire length to an equal length region of a UBE3A-ATS nucleic acid sequence that contains the pre-mRNA for SNORD116. In certain aspects, the antisense compound or oligonucleotide is a single-stranded oligonucleotide. In several aspects, the oligonucleotide is a modified oligonucleotide. In the same aspect, the modified oligonucleotide can comprise at least one modified internucleoside linkage. Yet again in the same aspect, the modified internucleoside linkage can be a phosphorothioate internucleoside linkage. In several aspects, at least one nucleoside comprises a modified sugar. In the same aspect, the modified sugar is a bicyclic sugar comprising a bridge between the 4' and the 2' positions of the sugar, such as a bridge is selected from 4'-CH(CH$_3$)—O-2', 4'-CH$_2$-2', 4'-(CH$_2$)$_2$-2', 4'-CH$_2$—O-2', 4'-(CH$_2$)$_2$—O-2', 4'-CH$_2$—O—N(R$_1$)-2' and 4'-CH2-N(R$_1$)—O-2'- wherein each R1 is, independently, H, a protecting group or C1-C12 alkyl. Further in the same aspect, the bridge is 4'-CH(CH$_3$)—O-2'.

In any of the preceding embodiments and aspects thereof including a modified sugar, the modified sugar can comprise a 2'-O-methoxyethyl group.

In any of the preceding embodiments and aspects thereof including a modified oligonucleotide, at least one nucleoside can comprise a modified nucleobase, such as a 5-methylcytosine.

In any of the foregoing embodiments and aspects thereof, the antisense compound or modified oligonucleotide is capable of inducing expression of paternal UBE3A by at least 20%, at least 30%, at least 40%, at least 50%, at least 60%, at least 70%, at least 80%, at least 90%, at least 100%, at least 110%, at least 120%, at least 130%, at least 140%, at least 150%, at least 160%, at least 170%, at least 180%, at least 190%, at least 200%, at least 210%, at least 220%, at least 230%, at least 240%, or at least 250%.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound may be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments, an antisense compound is 10-30 subunits in length. In certain embodiments, an antisense compound is 12 to 30 subunits in length. In certain embodiments, an antisense compound is 12 to 22 subunits in length. In certain embodiments, an antisense compound is 14 to 30 subunits in length. In certain embodiments, an antisense compound is 14 to 20 subunits in length. In certain embodiments, an antisense compound is 15 to 30 subunits in length. In certain embodiments, an antisense compound is 15 to 20 subunits in length. In certain embodiments, an antisense compound is 16 to 30 subunits in length. In certain embodiments, an antisense compound is 16 to 20 subunits in length. In certain embodiments, an antisense compound is 17 to 30 subunits in length. In certain embodiments, an antisense compound is 17 to 20 subunits in length. In certain embodiments, an antisense compound is 18 to 30 subunits in length. In certain embodiments, an antisense compound is 18 to 21 subunits in length. In certain embodiments, an antisense compound is 18 to 20 subunits in length. In certain embodiments, an antisense compound is 20 to 30 subunits in length. In other words, such antisense compounds are from 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits, respectively. In certain embodiments, an antisense compound is 14 subunits in length. In certain embodiments, an antisense compound is 16 subunits in length. In certain embodiments, an antisense compound is 17 subunits in length. In certain embodiments, an antisense compound is 18 subunits in length. In certain embodiments, an antisense compound is 20 subunits in length. In other embodiments, the antisense compound is 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the antisense compounds are 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In some embodiments the antisense compound is an antisense oligonucleotide, and the linked subunits are nucleotides.

In certain embodiments antisense oligonucleotides may be shortened or truncated. For example, a single subunit may be deleted from the 5' end (5' truncation), or alternatively from the 3' end (3' truncation). A shortened or truncated antisense compound targeted to a UBE3A-ATS nucleic acid may have two subunits deleted from the 5' end, or alternatively may have two subunits deleted from the 3' end, of the antisense compound. Alternatively, the deleted nucleosides may be dispersed throughout the antisense compound, for example, in an antisense compound having one nucleoside deleted from the 5' end and one nucleoside deleted from the 3' end.

When a single additional subunit is present in a lengthened antisense compound, the additional subunit may be located at the 5' or 3' end of the antisense compound. When two or more additional subunits are present, the added subunits may be adjacent to each other, for example, in an antisense compound having two subunits added to the 5' end (5' addition), or alternatively to the 3' end (3' addition), of the antisense compound. Alternatively, the added subunits may be dispersed throughout the antisense compound, for example, in an antisense compound having one subunit added to the 5' end and one subunit added to the 3' end.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al. (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (Nuc. Acid. Res. 16:3341-3358, 1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Certain Antisense Compound Motifs and Mechanisms

In certain embodiments, antisense compounds have chemically modified subunits arranged in patterns, or motifs, to confer to the antisense compounds properties such as enhanced inhibitory activity, increased binding affinity for a target nucleic acid, or resistance to degradation by in vivo nucleases. Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may confer another desired property e.g., serve as a substrate for the cellular endonuclease RNase H, which cleaves the RNA strand of an RNA:DNA duplex.

Antisense activity may result from any mechanism involving the hybridization of the antisense compound (e.g., oligonucleotide) with a target nucleic acid, wherein the hybridization ultimately results in a biological effect. In certain embodiments, the amount and/or activity of the target nucleic acid is modulated. In certain embodiments, the amount and/or activity of the target nucleic acid is reduced. In certain embodiments, hybridization of the antisense compound to the target nucleic acid ultimately results in target nucleic acid degradation. In certain embodiments, hybridization of the antisense compound to the target nucleic acid does not result in target nucleic acid degradation. In certain such embodiments, the presence of the antisense compound hybridized with the target nucleic acid (occupancy) results in a modulation of antisense activity. In certain embodiments, antisense compounds having a particular chemical motif or pattern of chemical modifications are particularly suited to exploit one or more mechanisms. In certain embodiments, antisense compounds function through more than one mechanism and/or through mechanisms that have not been elucidated. Accordingly, the antisense compounds described herein are not limited by particular mechanism.

Antisense mechanisms include, without limitation, RNase H mediated antisense; RNAi mechanisms, which utilize the RISC pathway and include, without limitation, siRNA, ssRNA and microRNA mechanisms; and occupancy based mechanisms. Certain antisense compounds may act through more than one such mechanism and/or through additional mechanisms.

RNase H-Mediated Antisense

In certain embodiments, antisense activity results at least in part from degradation of target RNA by RNase H. RNase H is a cellular endonuclease that cleaves the RNA strand of an RNA:DNA duplex. It is known in the art that single-stranded antisense compounds which are "DNA-like" elicit RNase H activity in mammalian cells. Accordingly, antisense compounds comprising at least a portion of DNA or DNA-like nucleosides may activate RNase H, resulting in cleavage of the target nucleic acid. In certain embodiments, antisense compounds that utilize RNase H comprise one or more modified nucleosides. In certain embodiments, such antisense compounds comprise at least one block of 1-8 modified nucleosides. In certain such embodiments, the modified nucleosides do not support RNase H activity. In certain embodiments, such antisense compounds are gapmers, as described herein. In certain such embodiments, the gap of the gapmer comprises DNA nucleosides. In certain such embodiments, the gap of the gapmer comprises DNA-like nucleosides. In certain such embodiments, the gap of the gapmer comprises DNA nucleosides and DNA-like nucleosides.

Certain antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may in some embodiments include β-D-ribonucleosides, β-D-deoxyribonucleosides, 2'-modified nucleosides (such 2'-modified nucleosides may include 2'-MOE and 2'-O—CH$_3$, among others), and bicyclic sugar modified nucleosides (such bicyclic sugar modified nucleosides may include those having a constrained ethyl). In certain embodiments, nucleosides in the wings may include several modified sugar moieties, including, for example 2'-MOE and bicyclic sugar moieties such as constrained ethyl or LNA. In certain embodiments, wings may include several modified and unmodified sugar moieties. In certain embodiments, wings may include various combinations of 2'-MOE nucleosides, bicyclic sugar moieties such as constrained ethyl nucleosides or LNA nucleosides, and 2'-deoxynucleosides.

Each distinct region may comprise uniform sugar moieties, variant, or alternating sugar moieties. The wing-gap-wing motif is frequently described as "X-Y-Z", where "X" represents the length of the 5'-wing, "Y" represents the length of the gap, and "Z" represents the length of the 3'-wing. "X" and "Z" may comprise uniform, variant, or alternating sugar moieties. In certain embodiments, "X" and "Y" may include one or more 2'-deoxynucleosides. "Y" may comprise 2'-deoxynucleosides. As used herein, a gapmer described as "X-Y-Z" has a configuration such that the gap is positioned immediately adjacent to each of the 5'-wing and the 3' wing. Thus, no intervening nucleotides exist between the 5'-wing and gap, or the gap and the 3'-wing. Any of the antisense compounds described herein can have a gapmer motif. In certain embodiments, "X" and "Z" are the same; in other embodiments they are different. In certain embodiments, "Y" is between 8 and 15 nucleosides. X, Y, or Z can be any of 1, 2, 3, 4, 5, 6, 7, 8, 9, 10, 11, 12, 13, 14, 15, 16, 17, 18, 19, 20, 25, 30 or more nucleosides.

In certain embodiments, the antisense compound targeted to a UBE3A-ATS nucleic acid has a gapmer motif in which the gap consists of 6, 7, 8, 9, 10, 11, 12, 13, 14, 15, or 16 linked nucleosides.

In certain embodiments, the antisense oligonucleotide has a sugar motif described by Formula A as follows: $(J)_m\text{-}(B)_n\text{-}(J)_p\text{-}(B)_r\text{-}(A)_t\text{-}(D)_g\text{-}(A)_v\text{-}(B)_w\text{-}(J)_x\text{-}(B)_y\text{-}(J)_z$ wherein:
each A is independently a 2'-substituted nucleoside;
each B is independently a bicyclic nucleoside;
each J is independently either a 2'-substituted nucleoside or a 2'-deoxynucleoside;
each D is a 2'-deoxynucleoside;
m is 0-4; n is 0-2; p is 0-2; r is 0-2; t is 0-2; v is 0-2; w is 0-2; x is 0-2; y is 0-2; z is 0-4; g is 6-14; provided that:
at least one of m, n, and r is other than 0;
at least one of w and y is other than 0;
the sum of m, n, p, r, and t is from 2 to 5; and
the sum of v, w, x, y, and z is from 2 to 5.

RNAi Compounds

In certain embodiments, antisense compounds are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). In certain embodiments, antisense compounds comprise modifications that make them particularly suited for such mechanisms.

i. ssRNA Compounds

In certain embodiments, antisense compounds including those particularly suited for use as single-stranded RNAi compounds (ssRNA) comprise a modified 5'-terminal end. In certain such embodiments, the 5'-terminal end comprises a modified phosphate moiety. In certain embodiments, such modified phosphate is stabilized (e.g., resistant to degradation/cleavage compared to unmodified 5'-phosphate). In certain embodiments, such 5'-terminal nucleosides stabilize the 5'-phosphorous moiety. Certain modified 5'-terminal nucleosides may be found in the art, for example in WO/2011/139702.

In certain embodiments, the 5'-nucleoside of an ssRNA compound has Formula IIc:

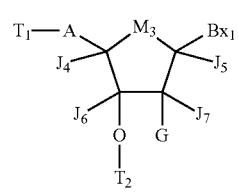

IIc wherein:
$T_1$ is an optionally protected phosphorus moiety;
$T_2$ is an internucleoside linking group linking the compound of Formula IIc to the oligomeric compound;
A has one of the formulas:

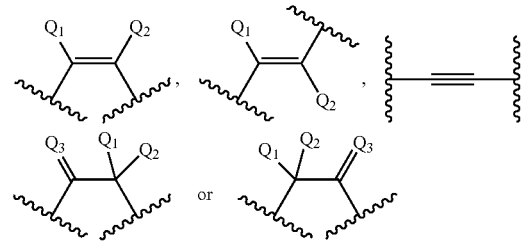

$Q_1$ and $Q_2$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl, substituted $C_2$-$C_6$ alkynyl or $N(R_3)(R_4)$;
$Q_3$ is O, S, $N(R_5)$ or $C(R_6)(R_7)$;
each $R_3$, $R_4$ $R_5$, $R_6$ and $R_7$ is, independently, H, $C_1$-$C_6$ alkyl, substituted $C_1$-$C_6$ alkyl or $C_1$-$C_6$ alkoxy;
$M_3$ is O, S, $NR_{14}$, $C(R_{15})(R_{16})$, $C(R_{15})(R_{16})C(R_{17})(R_{18})$, $C(R_{15})=C(R_{17})$, $OC(R_{15})(R_{16})$ or $OC(R_{15})(Bx_2)$;
$R_{14}$ is H, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;
$R_{15}$, $R_{16}$, $R_{17}$ and $R_{18}$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;
$Bx_1$ is a heterocyclic base moiety;
or if $Bx_2$ is present then $Bx_2$ is a heterocyclic base moiety and $Bx_1$ is H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;
$J_4$, $J_5$, $J_6$ and $J_7$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;
or $J_4$ forms a bridge with one of $J_5$ or $J_7$ wherein said bridge comprises from 1 to 3 linked biradical groups selected from O, S, $NR_{19}$, $C(R_{20})(R_{21})$, $C(R_{20})=C(R_{21})$, $C[=C(R_{20})(R_{21})]$ and $C(=O)$ and the other two of $J_5$, $J_6$ and $J_7$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

each $R_{19}$, $R_{20}$ and $R_{21}$ is, independently, H, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

G is H, OH, halogen or O—$[C(R_8)(R_9)]_n$—$[(C=O)_m$—$X_1]_j$—Z;

each $R_8$ and $R_9$ is, independently, H, halogen, $C_1$-$C_6$ alkyl or substituted $C_1$-$C_6$ alkyl;

$X_1$ is O, S or $N(E_1)$;

Z is H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or $N(E_2)(E_3)$;

$E_1$, $E_2$ and $E_3$ are each, independently, H, $C_1$-$C_6$ alkyl or substituted $C_1$-$C_6$ alkyl;

n is from 1 to about 6;

m is 0 or 1;

j is 0 or 1;

each substituted group comprises one or more optionally protected substituent groups independently selected from halogen, $OJ_1$, $N(J_1)(J_2)$, $=NJ_1$, $SJ_1$, $N_3$, CN, $OC(=X_2)J_1$, $OC(=X_2)N(J_1)(J_2)$ and $C(=X_2)N(J_1)(J_2)$;

$X_2$ is O, S or $NJ_3$;

each $J_1$, $J_2$ and $J_3$ is, independently, H or $C_1$-$C_6$ alkyl;

when j is 1 then Z is other than halogen or $N(E_2)(E_3)$; and wherein said oligomeric compound comprises from 8 to 40 monomeric subunits and is hybridizable to at least a portion of a target nucleic acid.

In certain embodiments, $M_3$ is O, CH=CH, $OCH_2$ or $OC(H)(Bx_2)$. In certain embodiments, $M_3$ is O.

In certain embodiments, $J_4$, $J_5$, $J_6$ and $J_7$ are each H. In certain embodiments, $J_4$ forms a bridge with one of $J_5$ or $J_7$.

In certain embodiments, A has one of the formulas:

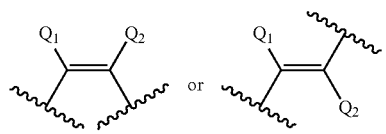

wherein:

$Q_1$ and $Q_2$ are each, independently, H, halogen, $C_1$-$C_6$ alkyl, substituted $C_1$-$C_6$ alkyl, $C_1$-$C_6$ alkoxy or substituted $C_1$-$C_6$ alkoxy. In certain embodiments, $Q_1$ and $Q_2$ are each H. In certain embodiments, $Q_1$ and $Q_2$ are each, independently, H or halogen. In certain embodiments, $Q_1$ and $Q_2$ is H and the other of $Q_1$ and $Q_2$ is F, $CH_3$ or $OCH_3$.

In certain embodiments, $T_1$ has the formula:

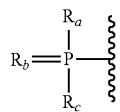

wherein:

$R_a$ and $R_c$ are each, independently, protected hydroxyl, protected thiol, $C_1$-$C_6$ alkyl, substituted $C_1$-$C_6$ alkyl, $C_1$-$C_6$ alkoxy, substituted $C_1$-$C_6$ alkoxy, protected amino or substituted amino; and $R_b$ is O or S. In certain embodiments, $R_b$ is O and $R_a$ and $R_c$ are each, independently, $OCH_3$, $OCH_2CH_3$ or $CH(CH_3)_2$.

In certain embodiments, G is halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2$—CH=$CH_2$, $O(CH_2)_2$—$OCH_3$, $O(CH_2)_2$—$SCH_3$, $O(CH_2)_2$—$OCF_3$, $O(CH_2)_3$—$N(R_{10})$($R_{11}$), $O(CH_2)_2$—$ON(R_{10})(R_{11})$, $O(CH_2)_2$—$O(CH_2)_2$—$N(R_{10})(R_{11})$, $OCH_2C(=O)$—$N(R_{10})(R_{11})$, $OCH_2C(=O)$—$N(R_{12})$—$(CH_2)_2$—$N(R_{10})(R_{11})$ or $O(CH_2)_2$—$N(R_{12})$—$C(=NR_{13})[N(R_{10})(R_{11})]$ wherein $R_{10}$, $R_{11}$, $R_{12}$ and $R_{13}$ are each, independently, H or $C_1$-$C_6$ alkyl. In certain embodiments, G is halogen, $OCH_3$, $OCF_3$, $OCH_2CH_3$, $OCH_2CF_3$, $OCH_2$—CH=$CH_2$, $O(CH_2)_2$—$OCH_3$, $O(CH_2)_2$—$O(CH_2)_2$—$N(CH_3)_2$, $OCH_2C(=O)$—$N(H)CH_3$, $OCH_2C(=O)$—$N(H)$—$(CH_2)_2$—$N(CH_3)_2$ or $OCH_2$—$N(H)$—$C(=NH)NH_2$. In certain embodiments, G is F, $OCH_3$ or $O(CH_2)_2$—$OCH_3$. In certain embodiments, G is $O(CH_2)_2$—$OCH_3$.

In certain embodiments, the 5'-terminal nucleoside has Formula IIe:

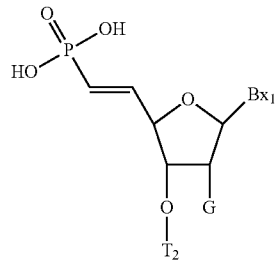

In certain embodiments, antisense compounds, including those particularly suitable for ssRNA comprise one or more type of modified sugar moieties and/or naturally occurring sugar moieties arranged along an oligonucleotide or region thereof in a defined pattern or sugar modification motif. Such motifs may include any of the sugar modifications discussed herein and/or other known sugar modifications.

In certain embodiments, the oligonucleotides comprise or consist of a region having uniform sugar modifications. In certain such embodiments, each nucleoside of the region comprises the same RNA-like sugar modification. In certain embodiments, each nucleoside of the region is a 2'-F nucleoside. In certain embodiments, each nucleoside of the region is a 2'-OMe nucleoside. In certain embodiments, each nucleoside of the region is a 2'-MOE nucleoside. In certain embodiments, each nucleoside of the region is a cEt nucleoside. In certain embodiments, each nucleoside of the region is an LNA nucleoside. In certain embodiments, the uniform region constitutes all or essentially all of the oligonucleotide. In certain embodiments, the region constitutes the entire oligonucleotide except for 1-4 terminal nucleosides.

In certain embodiments, oligonucleotides comprise one or more regions of alternating sugar modifications, wherein the nucleosides alternate between nucleotides having a sugar modification of a first type and nucleotides having a sugar modification of a second type. In certain embodiments, nucleosides of both types are RNA-like nucleosides. In certain embodiments the alternating nucleosides are selected from: 2'-OMe, 2'-F, 2'-MOE, LNA, and cEt. In certain embodiments, the alternating modifications are 2'-F and 2'-OMe. Such regions may be contiguous or may be interrupted by differently modified nucleosides or conjugated nucleosides.

In certain embodiments, the alternating region of alternating modifications each consist of a single nucleoside (i.e., the pattern is $(AB)_xA_y$ wherein A is a nucleoside having a sugar modification of a first type and B is a nucleoside having a sugar modification of a second type; x is 1-20 and y is 0 or 1). In certain embodiments, one or more alternating regions in an alternating motif includes more than a single nucleoside of a type. For example, oligonucleotides may include one or more regions of any of the following nucleoside motifs:
AABBAA;
ABBABB;
AABAAB;
ABBABAABB;
ABABAA;
AABABAB;
ABABAA;
ABBAABBABABAA;
BABBAABBABABAA; or
ABABBAABBABABAA;

wherein A is a nucleoside of a first type and B is a nucleoside of a second type. In certain embodiments, A and B are each selected from 2'-F, 2'-OMe, BNA, and MOE.

In certain embodiments, oligonucleotides having such an alternating motif also comprise a modified 5' terminal nucleoside, such as those of formula IIc or IIe.

In certain embodiments, oligonucleotides comprise a region having a 2-2-3 motif. Such regions comprises the following motif:

-(A)$_2$-(B)$_x$-(A)$_2$-(C)$_y$-(A)$_3$- wherein: A is a first type of modified nucleoside;
B and C, are nucleosides that are differently modified than A, however, B and C may have the same or different modifications as one another;
x and y are from 1 to 15.

In certain embodiments, A is a 2'-OMe modified nucleoside. In certain embodiments, B and C are both 2'-F modified nucleosides. In certain embodiments, A is a 2'-OMe modified nucleoside and B and C are both 2'-F modified nucleosides.

In certain embodiments, oligonucleosides have the following sugar motif:

5'-(Q)-(AB)$_x$A$_y$-(D)$_z$ wherein:
Q is a nucleoside comprising a stabilized phosphate moiety. In certain embodiments, Q is a nucleoside having Formula IIc or IIe;
A is a first type of modified nucleoside;
B is a second type of modified nucleoside;
D is a modified nucleoside comprising a modification different from the nucleoside adjacent to it. Thus, if y is 0, then D must be differently modified than B and if y is 1, then D must be differently modified than A. In certain embodiments, D differs from both A and B.
X is 5-15;
Y is 0 or 1;
Z is 0-4.

In certain embodiments, oligonucleosides have the following sugar motif:

5'-(Q)-(A)$_x$-(D)$_z$ wherein:
Q is a nucleoside comprising a stabilized phosphate moiety. In certain embodiments, Q is a nucleoside having Formula IIc or IIe;
A is a first type of modified nucleoside;
D is a modified nucleoside comprising a modification different from A.
X is 11-30;
Z is 0-4.

In certain embodiments A, B, C, and D in the above motifs are selected from: 2'-OMe, 2'-F, 2'-MOE, LNA, and cEt. In certain embodiments, D represents terminal nucleosides. In certain embodiments, such terminal nucleosides are not designed to hybridize to the target nucleic acid (though one or more might hybridize by chance). In certain embodiments, the nucleobase of each D nucleoside is adenine, regardless of the identity of the nucleobase at the corresponding position of the target nucleic acid. In certain embodiments the nucleobase of each D nucleoside is thymine.

In certain embodiments, antisense compounds, including those particularly suited for use as ssRNA comprise modified internucleoside linkages arranged along the oligonucleotide or region thereof in a defined pattern or modified internucleoside linkage motif. In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate internucleoside linkages. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least one block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

Oligonucleotides having any of the various sugar motifs described herein, may have any linkage motif. For example, the oligonucleotides, including but not limited to those described above, may have a linkage motif selected from non-limiting the table below:

| 5' most linkage | Central region | 3'-region |
|---|---|---|
| PS | Alternating PO/PS | 6 PS |
| PS | Alternating PO/PS | 7 PS |
| PS | Alternating PO/PS | 8 PS | ii. siRNA Compounds

In certain embodiments, antisense compounds are double-stranded RNAi compounds (siRNA). In such embodiments, one or both strands may comprise any modification motif described above for ssRNA. In certain embodiments, ssRNA compounds may be unmodified RNA. In certain embodiments, siRNA compounds may comprise unmodified RNA nucleosides, but modified internucleoside linkages.

Several embodiments relate to double-stranded compositions wherein each strand comprises a motif defined by the location of one or more modified or unmodified nucleosides. In certain embodiments, compositions are provided comprising a first and a second oligomeric compound that are fully or at least partially hybridized to form a duplex region and further comprising a region that is complementary to and hybridizes to a nucleic acid target. It is suitable that such a composition comprise a first oligomeric compound that is an antisense strand having full or partial complementarity to a nucleic acid target and a second oligomeric compound that is a sense strand having one or more regions of complementarity to and forming at least one duplex region with the first oligomeric compound.

The compositions of several embodiments modulate gene expression by hybridizing to a nucleic acid target resulting in loss of its normal function. In some embodiments, the target nucleic acid is UBE3A-ATS. In certain embodiment, the degradation of the targeted UBE3A-ATS is facilitated by an activated RISC complex that is formed with compositions of the invention.

Several embodiments are directed to double-stranded compositions wherein one of the strands is useful in, for example, influencing the preferential loading of the opposite strand into the RISC (or cleavage) complex. The compositions are useful for targeting selected nucleic acid molecules and modulating the expression of one or more genes. In some embodiments, the compositions of the present invention hybridize to a portion of a target RNA resulting in loss of normal function of the target RNA.

Certain embodiments are drawn to double-stranded compositions wherein both the strands comprises a hemimer motif, a fully modified motif, a positionally modified motif or an alternating motif Each strand of the compositions of the present invention can be modified to fulfil a particular role in for example the siRNA pathway. Using a different motif in each strand or the same motif with different chemical modifications in each strand permits targeting the antisense strand for the RISC complex while inhibiting the incorporation of the sense strand. Within this model, each strand can be independently modified such that it is enhanced for its particular role. The antisense strand can be modified at the 5'-end to enhance its role in one region of the RISC while the 3'-end can be modified differentially to enhance its role in a different region of the RISC.

The double-stranded oligonucleotide molecules can be a double-stranded polynucleotide molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. The double-stranded oligonucleotide molecules can be assembled from two separate oligonucleotides, where one strand is the sense strand and the other is the antisense strand, wherein the antisense and sense strands are self-complementary (i.e. each strand comprises nucleotide sequence that is complementary to nucleotide sequence in the other strand; such as where the antisense strand and sense strand form a duplex or double-stranded structure, for example wherein the double-stranded region is about 15 to about 30, e.g., about 15, 16, 17, 18, 19, 20, 21, 22, 23, 24, 25, 26, 27, 28, 29 or 30 base pairs; the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof (e.g., about 15 to about 25 or more nucleotides of the double-stranded oligonucleotide molecule are complementary to the target nucleic acid or a portion thereof). Alternatively, the double-stranded oligonucleotide is assembled from a single oligonucleotide, where the self-complementary sense and antisense regions of the siRNA are linked by means of a nucleic acid based or non-nucleic acid-based linker(s).

The double-stranded oligonucleotide can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The double-stranded oligonucleotide can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siRNA molecule capable of mediating RNAi.

In certain embodiments, the double-stranded oligonucleotide comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the double-stranded oligonucleotide comprises nucleotide sequence that is complementary to nucleotide sequence of a target gene. In another embodiment, the double-stranded oligonucleotide interacts with nucleotide sequence of a target gene in a manner that causes inhibition of expression of the target gene.

As used herein, double-stranded oligonucleotides need not be limited to those molecules containing only RNA, but further encompasses chemically modified nucleotides and non-nucleotides. In certain embodiments, the short interfering nucleic acid molecules lack 2'-hydroxy (2'-OH) containing nucleotides. In certain embodiments short interfering nucleic acids optionally do not include any ribonucleotides (e.g., nucleotides having a 2'-OH group). Such double-stranded oligonucleotides that do not require the presence of ribonucleotides within the molecule to support RNAi can however have an attached linker or linkers or other attached or associated groups, moieties, or chains containing one or more nucleotides with 2'-OH groups. Optionally, double-stranded oligonucleotides can comprise ribonucleotides at about 5, 10, 20, 30, 40, or 50% of the nucleotide positions. As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term RNAi is meant to be equivalent to other terms used to describe sequence specific RNA interference, such as post transcriptional gene silencing, translational inhibition, or epigenetics. For example, double-stranded oligonucleotides can be used to epigenetically silence genes at both the post-transcriptional level and the pre-transcriptional level. In a non-limiting example, epigenetic regulation of gene expression by siRNA molecules of the invention can result from siRNA mediated modification of chromatin structure or methylation pattern to alter gene expression (see, for example, Verdel et al., 2004, Science, 303, 672-676; Pal-Bhadra et al., 2004, Science, 303, 669-672; Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237).

It is contemplated that compounds and compositions of several embodiments provided herein can target UBE3A-ATS by a dsRNA-mediated gene silencing or RNAi mechanism, including, e.g., "hairpin" or stem-loop double-stranded RNA effector molecules in which a single RNA strand with self-complementary sequences is capable of assuming a double-stranded conformation, or duplex dsRNA effector molecules comprising two separate strands of RNA. In various embodiments, the dsRNA consists entirely of ribonucleotides or consists of a mixture of ribonucleotides and deoxynucleotides, such as the RNA/DNA hybrids disclosed, for example, by WO 00/63364, filed Apr. 19, 2000, or U.S. Ser. No. 60/130,377, filed Apr. 21, 1999. The dsRNA or dsRNA effector molecule may be a single molecule with a region of self-complementarity such that nucleotides in one segment of the molecule base pair with nucleotides in another segment of the molecule. In various embodiments, a dsRNA that consists of a single molecule consists entirely of ribonucleotides or includes a region of ribonucleotides that is complementary to a region of deoxyribonucleotides. Alternatively, the dsRNA may include two different strands that have a region of complementarity to each other.

In various embodiments, both strands consist entirely of ribonucleotides, one strand consists entirely of ribonucleotides and one strand consists entirely of deoxyribonucleotides, or one or both strands contain a mixture of ribonucleotides and deoxyribonucleotides. In certain embodiments, the regions of complementarity are at least 70, 80, 90, 95, 98, or 100% complementary to each other and to a target nucleic acid sequence. In certain embodiments, the region of the dsRNA that is present in a double-stranded conformation includes at least 19, 20, 21, 22, 23, 24, 25, 26, 27, 28, 29, 30, 50, 75, 100, 200, 500, 1000, 2000 or 5000 nucleotides or includes all of the nucleotides in a cDNA or other target nucleic acid sequence being represented in the dsRNA. In some embodiments, the dsRNA does not contain any single stranded regions, such as single stranded ends, or the dsRNA is a hairpin. In other embodiments, the dsRNA has one or more single stranded regions or overhangs. In certain embodiments, RNA/DNA hybrids include a DNA strand or region that is an antisense strand or region (e.g, has at least 70, 80, 90, 95, 98, or 100% complementarity to a target nucleic acid) and an RNA strand or region that is a sense strand or region (e.g, has at least 70, 80, 90, 95, 98, or 100% identity to a target nucleic acid), and vice versa.

In various embodiments, the RNA/DNA hybrid is made in vitro using enzymatic or chemical synthetic methods such as those described herein or those described in WO 00/63364, filed Apr. 19, 2000, or U.S. Ser. No. 60/130,377, filed Apr. 21, 1999. In other embodiments, a DNA strand synthesized in vitro is complexed with an RNA strand made in vivo or in vitro before, after, or concurrent with the transformation of the DNA strand into the cell. In yet other embodiments, the dsRNA is a single circular nucleic acid containing a sense and an antisense region, or the dsRNA includes a circular nucleic acid and either a second circular nucleic acid or a linear nucleic acid (see, for example, WO 00/63364, filed Apr. 19, 2000, or U.S. Ser. No. 60/130,377, filed Apr. 21, 1999.) Exemplary circular nucleic acids include lariat structures in which the free 5' phosphoryl group of a nucleotide becomes linked to the 2' hydroxyl group of another nucleotide in a loop back fashion.

In other embodiments, the dsRNA includes one or more modified nucleotides in which the 2' position in the sugar contains a halogen (such as fluorine group) or contains an alkoxy group (such as a methoxy group) which increases the half-life of the dsRNA in vitro or in vivo compared to the corresponding dsRNA in which the corresponding 2' position contains a hydrogen or an hydroxyl group. In yet other embodiments, the dsRNA includes one or more linkages between adjacent nucleotides other than a naturally-occurring phosphodiester linkage. Examples of such linkages include phosphoramide, phosphorothioate, and phosphorodithioate linkages. The dsRNAs may also be chemically modified nucleic acid molecules as taught in U.S. Pat. No. 6,673,661. In other embodiments, the dsRNA contains one or two capped strands, as disclosed, for example, by WO 00/63364, filed Apr. 19, 2000, or U.S. Ser. No. 60/130,377, filed Apr. 21, 1999.

In other embodiments, the dsRNA can be any of the at least partially dsRNA molecules disclosed in WO 00/63364, as well as any of the dsRNA molecules described in U.S. Provisional Application 60/399,998; and U.S. Provisional Application 60/419,532, and PCT/US2003/033466, the teaching of which is hereby incorporated by reference. Any of the dsRNAs may be expressed in vitro or in vivo using the methods described herein or standard methods, such as those described in WO 00/63364.

Occupancy

In certain embodiments, antisense compounds are not expected to result in cleavage or the target nucleic acid via RNase H or to result in cleavage or sequestration through the RISC pathway. In certain such embodiments, antisense activity may result from occupancy, wherein the presence of the hybridized antisense compound disrupts the activity of the target nucleic acid. In certain such embodiments, the antisense compound may be uniformly modified or may comprise a mix of modifications and/or modified and unmodified nucleosides.

Target Nucleic Acids, Target Regions and Nucleotide Sequences

In certain embodiments, the UBE3A-ATS nucleic acid comprises the sequence set forth in the complement of GENBANK accession number NT 187035.1 truncated from nucleotides 20128178 to 21349207, herein referred to as SEQ ID NO: 1. The MBII-85 snoRNA region is found within nucleotides 545131 to 776518 of SEQ ID NO: 1. The mouse and human genomic loci corresponding to these SEQ ID NOs share a highly conserved genomic organization that includes a Snrpn gene, snoRNAs, and UBE3A-ATS in the same structural arrangement along their syntenic chromosomes. In addition to the highly conserved genomic map of the mouse and human syntenic loci, the genomic imprinting mechanism is also conserved at this loci; in mice and humans, most neurons express Ube3a only from the maternally-inherited allele. (Huang, H. S. et al., Nature, 481: 185-189, 2012).

Certain embodiments relate to a method of inducing expression of paternal UBE3A in a cell comprising contacting the cell with an antisense compound targeted to UBE3A-ATS within nucleotides 545131 to 776518 of SEQ ID NO: 1, wherein UBE3A-ATS comprises a nucleic acid sequence at least 85% identical to the sequence of SEQ ID NO:1.
Hybridization In some embodiments, hybridization occurs between an antisense compound disclosed herein and an UBE3A-ATS. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art. In certain embodiments, the antisense compounds provided herein are specifically hybridizable with UBE3A-ATS.
Complementarity An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as a UBE3A-ATS nucleic acid).

Non-complementary nucleobases between an antisense compound and a UBE3A-ATS nucleic acid may be tolerated provided that the antisense compound remains able to specifically hybridize to a target nucleic acid. Moreover, an antisense compound may hybridize over one or more segments of a UBE3A-ATS nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 80%, 85%, 86%, 87%, 88%, 89%, 90%, 91%, 92%, 93%, 94%, 95%, 96%, 97%, 98%, 99%, or 100% complementary to a UBE3A-ATS nucleic acid, a target region, target segment, or specified portion thereof. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having four non-complementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, an antisense compound may be fully complementary to a UBE3A-ATS nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound may or may not be fully complementary to the target sequence, depending on whether the remaining 10 nucleobases of the antisense compound are also complementary to the target sequence.

The location of a non-complementary nucleobase may be at the 5' end or 3' end of the antisense compound. Alternatively, the non-complementary nucleobase or nucleobases may be at an internal position of the antisense compound. When two or more non-complementary nucleobases are present, they may be contiguous (i.e. linked) or non-contiguous. In one embodiment, a non-complementary nucleobase is located in the wing segment of a gapmer antisense oligonucleotide.

In certain embodiments, antisense compounds that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a UBE3A-ATS nucleic acid, or specified portion thereof.

In certain embodiments, antisense compounds that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a UBE3A-ATS nucleic acid, or specified portion thereof.

The antisense compounds provided also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 9 nucleobase portion of a target segment. In certain embodiments, the antisense compounds are complementary to at least a 10 nucleobase portion of a target segment. In certain embodiments, the antisense compounds are complementary to at least an 11 nucleobase portion of a target segment. In certain embodiments, the antisense compounds are complementary to at least a 12 nucleobase portion of a target segment. In certain embodiments, the antisense compounds are complementary to at least a 13 nucleobase portion of a target segment. In certain embodiments, the antisense compounds are complementary to at least a 14 nucleobase portion of a target segment. In certain embodiments, the antisense compounds are complementary to at least a 15 nucleobase portion of a target segment. Also contemplated are antisense compounds that are complementary to at least a 9, 10, 11, 12, 13, 14, 15, 16, 17, 18, 19, 20, or more nucleobase portion of a target segment, or a range defined by any two of these values.

Identity

The antisense compounds provided herein may also have a defined percent identity to a particular nucleotide sequence, SEQ ID NO, or compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases may be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are at least 70%, 75%, 80%, 85%, 90%, 95%, 96%, 97%, 98%, 99% or 100% identical to one or more of the antisense compounds or SEQ ID NOs, or a portion thereof, disclosed herein.

In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, a portion of the antisense oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides may also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to a UBE3A-ATS nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

Modified Sugar Moieties

Antisense compounds can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise chemically modified ribofuranose ring moieties. Examples of chemically modified ribofuranose rings include without limitation, addition of substitutent groups (including 5' and 2' substituent groups, bridging of non-geminal ring atoms to form bicyclic nucleic acids (BNA), replacement of the ribosyl ring oxygen atom with S, N(R), or $C(R_1)(R_2)$ (R, $R_1$ and $R_2$ are each independently H, $C_1$-$C_{12}$ alkyl or a protecting group) and combinations thereof. Examples of chemically modified sugars include 2'-F-5'-methyl substituted nucleoside (see PCT International Application WO 2008/101157 Published on Aug. 21, 2008 for other disclosed 5',2'-bis substituted nucleosides) or replacement of the ribosyl ring oxygen atom with S with further substitution at the 2'-position (see published U.S. Patent Application US2005-0130923, published on Jun. 16, 2005) or alternatively 5'-substitution of a BNA (see PCT International Application WO 2007/134181 Published on Nov. 22, 2007 wherein LNA is substituted with for example a 5'-methyl or a 5'-vinyl group).

Examples of nucleosides having modified sugar moieties include without limitation nucleosides comprising 5'-vinyl, 5'-methyl (R or S), 4'-S, 2'-F, 2'-$OCH_3$, 2'-$OCH_2CH_3$, 2'-$OCH_2CH_2F$ and 2'-$O(CH_2)_2OCH_3$ substituent groups. The substituent at the 2' position can also be selected from allyl, amino, azido, thio, O-allyl, O—$C_1$-$C_{10}$ alkyl, $OCF_3$, $OCH_2F$, $O(CH_2)_2SCH_3$, $O(CH_2)_2$—O—$N(R_m)(R_n)$, O—$CH_2$—C(=O)—$N(R_m)(R_n)$, and O—$CH_2$—C(=O)—$N(R_1)$—$(CH_2)_2$—$N(R_m)(R_n)$, where each $R_l$, $R_m$ and $R_n$ is, independently, H or substituted or unsubstituted $C_1$-$C_{10}$ alkyl.

As used herein, "bicyclic nucleosides" refer to modified nucleosides comprising a bicyclic sugar moiety. Examples of bicyclic nucleosides include without limitation nucleosides comprising a bridge between the 4' and the 2' ribosyl ring atoms. In certain embodiments, antisense compounds provided herein include one or more bicyclic nucleosides comprising a 4' to 2' bridge. Examples of such 4' to 2' bridged bicyclic nucleosides, include but are not limited to one of the formulae: 4'-($CH_2$)—O-2' (LNA); 4'-($CH_2$)—S-2; 4'-$(CH_2)_2$—O-2' (ENA); 4'-CH($CH_3$)—O-2' (also referred to as constrained ethyl or cEt) and 4'-CH($CH_2OCH_3$)—O-2' (and analogs thereof see U.S. Pat. No. 7,399,845, issued on Jul. 15, 2008); 4'-C($CH_3$)($CH_3$)—O-2' (and analogs thereof see published International Application WO/2009/006478, published Jan. 8, 2009); 4'-$CH_2$—N($OCH_3$)-2' (and analogs thereof see published International Application WO/2008/150729, published Dec. 11, 2008); 4'-$CH_2$—O—N($CH_3$)-2' (see published U.S. Patent Application US2004-0171570, published Sep. 2, 2004); 4'-$CH_2$—N(R)—O-2', wherein R is H, $C_1$-$C_{12}$ alkyl, or a protecting group (see U.S. Pat. No. 7,427,672, issued on Sep. 23, 2008); 4'-$CH_2$—C—(H)($CH_3$)-2' (see Chattopadhyaya et al., *J. Org. Chem.*, 2009, 74, 118-134); and 4'-$CH_2$—C(=$CH_2$)-2' (and analogs thereof see published International Application WO 2008/154401, published on Dec. 8, 2008).

Further reports related to bicyclic nucleosides can also be found in published literature (see for example: Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129(26) 8362-8379; Elayadi et al., *Curr. Opinion Invest. Drugs*, 2001, 2, 558-561; Braasch et al., *Chem. Biol.*, 2001, 8, 1-7; and Orum et al., *Curr. Opinion Mol. Ther.*, 2001, 3, 239-243; U.S. Pat. Nos. 6,268,490; 6,525,191; 6,670,461; 6,770,748; 6,794,499; 7,034,133; 7,053,207; 7,399,845; 7,547,684; and 7,696,345; U.S. Patent Publication No. US2008-0039618; US2009-0012281; U.S. Patent Ser. Nos. 60/989,574; 61/026,995; 61/026,998; 61/056,564; 61/086,231; 61/097,787; and 61/099,844; Published PCT International applications WO 1994/014226; WO 2004/106356; WO 2005/021570; WO 2007/134181; WO 2008/150729; WO 2008/154401; and WO 2009/006478. Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

In certain embodiments, bicyclic sugar moieties of BNA nucleosides include, but are not limited to, compounds having at least one bridge between the 4' and 2' position of the pentofuranosyl sugar moiety wherein such bridges independently comprises 1 or from 2 to 4 linked groups independently selected from —$[C(R_a)(R_b)]_n$—, —$C(R_a)$=$C(R_b)$—, —$C(R_a)$=N—, —C(=O)—, —C(=$NR_a$)—, —C(=S)—, —O—, —$Si(R_a)_2$—, —S(=O)$_x$—, and —$N(R_a)$—;

wherein:

x is 0, 1, or 2;

n is 1, 2, 3, or 4;

each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl or a protecting group.

In certain embodiments, the bridge of a bicyclic sugar moiety is —$[C(R_a)(R_b)]_n$—, —$[C(R_a)(R_b)]_n$—O—, —$C(R_aR_b)$—N(R)—O— or —$C(R_aR_b)$—O—N(R)—. In certain embodiments, the bridge is 4'-$CH_2$-2', 4'-$(CH_2)_2$-2', 4'-$(CH_2)_3$-2', 4'-$CH_2$—O-2', 4'-$(CH_2)_2$—O-2', 4'-$CH_2$—O—N(R)-2' and 4'-$CH_2$—N(R)—O-2'- wherein each R is, independently, H, a protecting group or $C_1$-$C_{12}$ alkyl.

In certain embodiments, bicyclic nucleosides are further defined by isomeric configuration. For example, a nucleoside comprising a 4'-2' methylene-oxy bridge, may be in the α-L configuration or in the β-D configuration. Previously, α-L-methyleneoxy (4'-$CH_2$—O-2') BNA's have been incorporated into antisense oligonucleotides that showed antisense activity (Frieden et al., *Nucleic Acids Research*, 2003, 21, 6365-6372).

In certain embodiments, bicyclic nucleosides include, but are not limited to, (A) α-L-methyleneoxy (4'-$CH_2$—O-2') BNA, (B) β-D-methyleneoxy (4'-$CH_2$—O-2') BNA, (C) ethyleneoxy (4'-$(CH_2)_2$—O-2') BNA, (D) aminooxy (4'-$CH_2$—O—N(R)-2') BNA, (E) oxyamino (4'-$CH_2$—N(R)—O-2') BNA, and (F) methyl(methyleneoxy) (4'-CH($CH_3$)—O-2') BNA, (G) methylene-thio (4'-$CH_2$—S-2') BNA, (H) methylene-amino (4'-$CH_2$—N(R)-2') BNA, (I) methyl carbocyclic (4'-$CH_2$—CH($CH_3$)-2') BNA, (J) propylene carbocyclic (4'-$(CH_2)_3$-2') BNA and (K) vinyl BNA as depicted below:

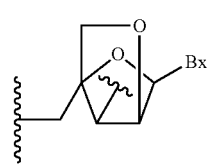

(A)

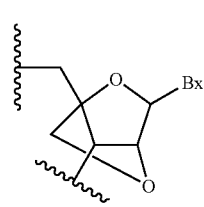

(B)

-continued (C) 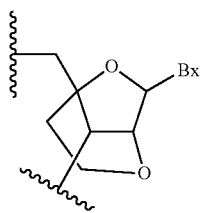

(D) 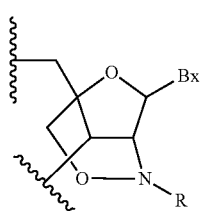

(E) 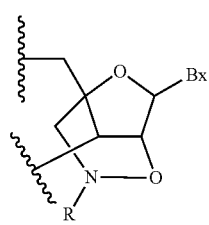

(F) 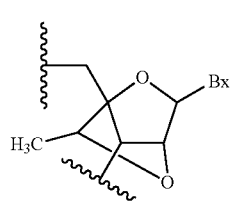

(G) 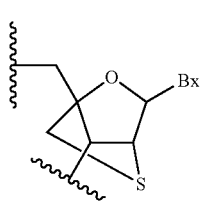

(H) 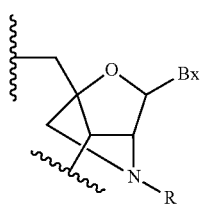

(I) 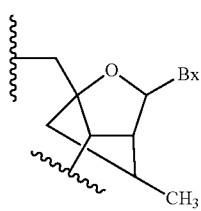

-continued (J) 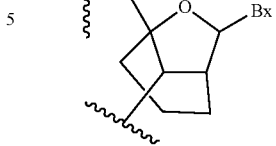

(K) 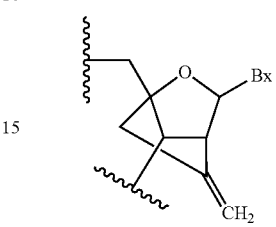

wherein Bx is the base moiety and R is independently H, a protecting group, $C_1$-$C_{12}$ alkyl or $C_1$-$C_{12}$ alkoxy.

In certain embodiments, bicyclic nucleosides are provided having Formula I:

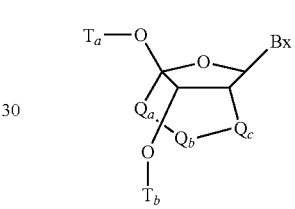

I wherein:
Bx is a heterocyclic base moiety;
-$Q_a$-$Q_b$-$Q_c$- is —$CH_2$—N($R_c$)—$CH_2$—, —C(=O)—N($R_c$)—$CH_2$—, —$CH_2$—O—N($R_c$)—, —$CH_2$—N($R_c$)—O— or —N($R_c$)—O—$CH_2$;
$R_c$ is $C_1$-$C_{12}$ alkyl or an amino protecting group; and
$T_a$ and $T_b$ are each, independently, H, a hydroxyl protecting group, a conjugate group, a reactive phosphorus group, a phosphorus moiety or a covalent attachment to a support medium.

In certain embodiments, bicyclic nucleosides are provided having Formula II:

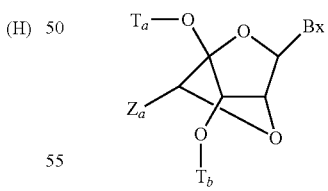

II wherein:
Bx is a heterocyclic base moiety;
$T_a$ and $T_b$ are each, independently, H, a hydroxyl protecting group, a conjugate group, a reactive phosphorus group, a phosphorus moiety or a covalent attachment to a support medium;
$Z_a$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol or substituted thio.

In one embodiment, each of the substituted groups is, independently, mono or poly substituted with substituent groups independently selected from halogen, oxo, hydroxyl, $OJ_c$, $NJ_cJ_d$, $SJ_c$, $N_3$, $OC(=X)J_c$, and $NJ_cC(=X)NJ_eJ_d$, wherein each $J_c$, $J_d$ and $J_e$ is, independently, H, $C_1$-$C_6$ alkyl, or substituted $C_1$-$C_6$ alkyl and X is O or $NJ_c$.

In certain embodiments, bicyclic nucleosides are provided having Formula III:

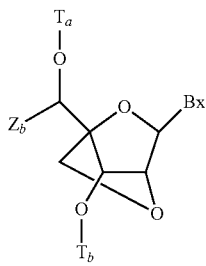

III wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_b$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl or substituted acyl (C(=O)—).

In certain embodiments, bicyclic nucleosides are provided having Formula IV:

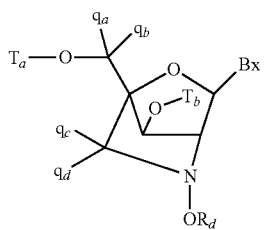

IV wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$R_d$ is $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl;

each $q_a$, $q_b$, $q_c$ and $q_d$ is, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl, $C_1$-$C_6$ alkoxyl, substituted $C_1$-$C_6$ alkoxyl, acyl, substituted acyl, $C_1$-$C_6$ aminoalkyl or substituted $C_1$-$C_6$ aminoalkyl;

In certain embodiments, bicyclic nucleosides are provided having Formula V:

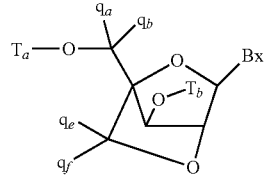

V wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$q_a$, $q_b$, $q_e$ and $q_f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)-$NJ_jJ_k$, N(H)C(=NH)$NJ_jJ_k$, N(H)C(=O)$NJ_jJ_k$ or N(H)C(=S)$NJ_jJ_k$;

or $q_e$ and $q_f$ together are =C($q_g$)($q_h$);

$q_g$ and $q_h$ are each, independently, H, halogen, $C_1$-$C_{12}$ alkyl or substituted $C_1$-$C_{12}$ alkyl.

The synthesis and preparation of the methyleneoxy (4'-CH$_2$—O-2') BNA monomers adenine, cytosine, guanine, 5-methyl-cytosine, thymine and uracil, along with their oligomerization, and nucleic acid recognition properties have been described (Koshkin et al., *Tetrahedron*, 1998, 54, 3607-3630). BNAs and preparation thereof are also described in WO 98/39352 and WO 99/14226.

Analogs of methyleneoxy (4'-CH$_2$—O-2') BNA and 2'-thio-BNAs, have also been prepared (Kumar et al., *Bioorg. Med. Chem. Lett.*, 1998, 8, 2219-2222). Preparation of locked nucleoside analogs comprising oligodeoxyribonucleotide duplexes as substrates for nucleic acid polymerases has also been described (Wengel et al., WO 99/14226). Furthermore, synthesis of 2'-amino-BNA, a novel conformationally restricted high-affinity oligonucleotide analog has been described in the art (Singh et al., *J. Org. Chem.*, 1998, 63, 10035-10039). In addition, 2'-amino- and 2'-methylamino-BNA's have been prepared and the thermal stability of their duplexes with complementary RNA and DNA strands has been previously reported.

In certain embodiments, bicyclic nucleosides are provided having Formula VI:

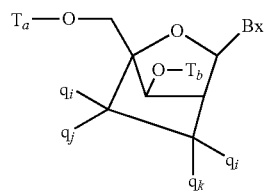

VI wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

each $q_i$, $q_j$, $q_k$ and $q_l$ is, independently, H, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxyl, substituted $C_1$-$C_{12}$ alkoxyl, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$; and $q_i$ and $q_j$ or $q_l$ and $q_k$ together are =C($q_g$)($q_h$), wherein $q_g$ and $q_h$ are each, independently, H, halogen, $C_1$-$C_{12}$ alkyl or substituted $C_1$-$C_{12}$ alkyl.

One carbocyclic bicyclic nucleoside having a 4'-(CH$_2$)$_3$-2' bridge and the alkenyl analog bridge 4'-CH=CH—CH$_2$-2' have been described (Freier et al., *Nucleic Acids Research*, 1997, 25(22), 4429-4443 and Albaek et al., *J. Org. Chem.*, 2006, 71, 7731-7740). The synthesis and preparation of carbocyclic bicyclic nucleosides along with their oligomerization and biochemical studies have also been described (Srivastava et al., *J. Am. Chem. Soc.*, 2007, 129(26), 8362-8379).

As used herein, "4'-2' bicyclic nucleoside" or "4' to 2' bicyclic nucleoside" refers to a bicyclic nucleoside comprising a furanose ring comprising a bridge connecting two carbon atoms of the furanose ring connects the 2' carbon atom and the 4' carbon atom of the sugar ring.

As used herein, "monocyclic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: O[(CH$_2$)$_n$O]$_m$CH$_3$, O(CH$_2$)$_n$NH$_2$, O(CH$_2$)$_n$CH$_3$, O(CH$_2$)$_n$F, O(CH$_2$)$_n$ONH$_2$, OCH$_2$C(=O)N(H)CH$_3$, and O(CH$_2$)$_n$ON[(CH$_2$)$_n$CH$_3$]$_2$, where n and m are from 1 to about 10. Other 2'-substituent groups can also be selected from: $C_1$-$C_{12}$ alkyl, substituted alkyl, alkenyl, alkynyl, alkaryl, aralkyl, O-alkaryl or O-aralkyl, SH, SCH$_3$, OCN, Cl, Br, CN, F, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving pharmacokinetic properties, or a group for improving the pharmacodynamic properties of an antisense compound, and other substituents having similar properties. In certain embodiments, modified nucleosides comprise a 2'-MOE side chain (Baker et al., *J. Biol. Chem.*, 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (Martin, *Helv. Chim. Acta*, 1995, 78, 486-504; Altmann et al., *Chimia*, 1996, 50, 168-176; Altmann et al., *Biochem. Soc. Trans.*, 1996, 24, 630-637; and Altmann et al., *Nucleosides Nucleotides*, 1997, 16, 917-926).

As used herein, a "modified tetrahydropyran nucleoside" or "modified THP nucleoside" means a nucleoside having a six-membered tetrahydropyran "sugar" substituted in for the pentofuranosyl residue in normal nucleosides (a sugar surrogate). Modified THP nucleosides include, but are not limited to, what is referred to in the art as hexitol nucleic acid (HNA), anitol nucleic acid (ANA), manitol nucleic acid (MNA) (see Leumann, *Bioorg. Med. Chem.*, 2002, 10, 841-854) or fluoro HNA (F-HNA) having a tetrahydropyran ring system as illustrated below:

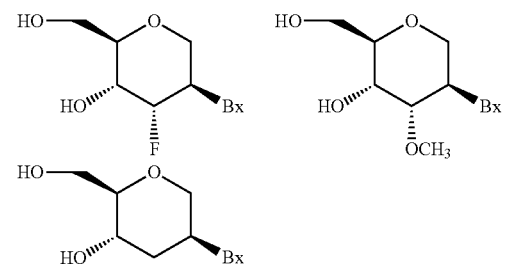

In certain embodiments, sugar surrogates are selected having Formula VII:

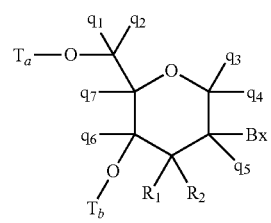

VII wherein independently for each of said at least one tetrahydropyran nucleoside analog of Formula VII:

Bx is a heterocyclic base moiety;

$T_a$ and $T_b$ are each, independently, an internucleoside linking group linking the tetrahydropyran nucleoside analog to the antisense compound or one of $T_a$ and $T_b$ is an internucleoside linking group linking the tetrahydropyran nucleoside analog to the antisense compound and the other of $T_a$ and $T_b$ is H, a hydroxyl protecting group, a linked conjugate group or a 5' or 3'-terminal group;

$q_1$, $q_2$, $q_3$, $q_4$, $q_5$, $q_6$ and $q_7$ are each independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl; and each of $R_1$ and $R_2$ is selected from hydrogen, hydroxyl, halogen, substituted or unsubstituted alkoxy, $NJ_1J_2$, $SJ_1$, $N_3$, OC(=X)$J_1$, OC(=X)$NJ_1J_2$, $NJ_3$C(=X)$NJ_1J_2$ and CN, wherein X is O, S or $NJ_1$ and each $J_1$, $J_2$ and $J_3$ is, independently, H or $C_1$-$C_6$ alkyl.

In certain embodiments, the modified THP nucleosides of Formula VII are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, THP nucleosides of Formula VII are provided wherein one of $R_1$ and $R_2$ is fluoro. In certain embodiments, $R_1$ is fluoro and $R_2$ is H; $R_1$ is methoxy and $R_2$ is H, and $R_1$ is methoxyethoxy and $R_2$ is H.

In certain embodiments, sugar surrogates comprise rings having more than 5 atoms and more than one heteroatom. For example nucleosides comprising morpholino sugar moieties and their use in oligomeric compounds has been reported (see for example: Braasch et al., *Biochemistry*, 2002, 41, 4503-4510; and U.S. Pat. Nos. 5,698,685; 5,166,315; 5,185,444; and 5,034,506). As used here, the term "morpholino" means a sugar surrogate having the following formula:

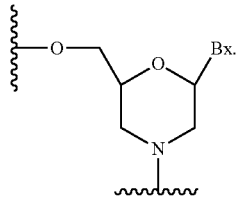

In certain embodiments, morpholinos may be modified, for example by adding or altering various substituent groups from the above morpholino structure. Such sugar surrogates are referred to herein as "modified morpholinos."

Combinations of modifications are also provided without limitation, such as 2'-F-5'-methyl substituted nucleosides (see PCT International Application WO 2008/101157 published on Aug. 21, 2008 for other disclosed 5', 2'-bis substituted nucleosides) and replacement of the ribosyl ring oxygen atom with S and further substitution at the 2'-position (see published U.S. Patent Application US2005-0130923, published on Jun. 16, 2005) or alternatively 5'-substitution of a bicyclic nucleic acid (see PCT International Application WO 2007/134181, published on Nov. 22, 2007 wherein a 4'-CH$_2$—O-2' bicyclic nucleoside is further substituted at the 5' position with a 5'-methyl or a 5'-vinyl group). The synthesis and preparation of carbocyclic bicyclic nucleosides along with their oligomerization and biochemical studies have also been described (see, e.g., Srivastava et al., J. Am. Chem. Soc. 2007, 129(26), 8362-8379).

In certain embodiments, antisense compounds comprise one or more modified cyclohexenyl nucleosides, which is a nucleoside having a six-membered cyclohexenyl in place of the pentofuranosyl residue in naturally occurring nucleosides. Modified cyclohexenyl nucleosides include, but are not limited to those described in the art (see for example commonly owned, published PCT Application WO 2010/036696, published on Apr. 10, 2010, Robeyns et al., J. Am. Chem. Soc., 2008, 130(6), 1979-1984; Horvath et al., Tetrahedron Letters, 2007, 48, 3621-3623; Nauwelaerts et al., J. Am. Chem. Soc., 2007, 129(30), 9340-9348; Gu et al., Nucleosides, Nucleotides & Nucleic Acids, 2005, 24(5-7), 993-998; Nauwelaerts et al., Nucleic Acids Research, 2005, 33(8), 2452-2463; Robeyns et al., Acta Crystallographica, Section F: Structural Biology and Crystallization Communications, 2005, F61(6), 585-586; Gu et al., Tetrahedron, 2004, 60(9), 2111-2123; Gu et al., Oligonucleotides, 2003, 13(6), 479-489; Wang et al., J. Org. Chem., 2003, 68, 4499-4505; Verbeure et al., Nucleic Acids Research, 2001, 29(24), 4941-4947; Wang et al., J. Org. Chem., 2001, 66, 8478-82; Wang et al., Nucleosides, Nucleotides & Nucleic Acids, 2001, 20(4-7), 785-788; Wang et al., J. Am. Chem., 2000, 122, 8595-8602; Published PCT application, WO 06/047842; and Published PCT Application WO 01/049687; the text of each is incorporated by reference herein, in their entirety). Certain modified cyclohexenyl nucleosides have Formula X.

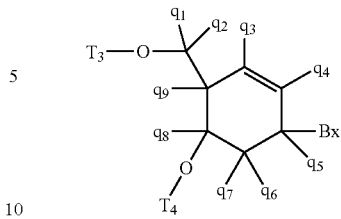

wherein independently for each of said at least one cyclohexenyl nucleoside analog of Formula X:
Bx is a heterocyclic base moiety;
$T_3$ and $T_4$ are each, independently, an internucleoside linking group linking the cyclohexenyl nucleoside analog to an antisense compound or one of $T_3$ and $T_4$ is an internucleoside linking group linking the tetrahydropyran nucleoside analog to an antisense compound and the other of $T_3$ and $T_4$ is H, a hydroxyl protecting group, a linked conjugate group, or a 5'- or 3'-terminal group; and
$q_1$, $q_2$, $q_3$, $q_4$, $q_5$, $q_6$, $q_7$, $q_8$ and $q_9$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or other sugar substituent group.

As used herein, "2'-modified" or "2'-substituted" refers to a nucleoside comprising a sugar comprising a substituent at the 2' position other than H or OH. 2'-modified nucleosides, include, but are not limited to, bicyclic nucleosides wherein the bridge connecting two carbon atoms of the sugar ring connects the 2' carbon and another carbon of the sugar ring; and nucleosides with non-bridging 2'substituents, such as allyl, amino, azido, thio, O-allyl, O—$C_1$-$C_{10}$ alkyl, —OCF$_3$, O—(CH$_2$)$_2$—O—CH$_3$, 2'-O(CH$_2$)$_2$SCH$_3$, O—(CH$_2$)$_2$—O—N($R_m$)($R_n$), or O—CH$_2$—C(=O)—N($R_m$)($R_n$), where each $R_m$ and $R_n$ is, independently, H or substituted or unsubstituted $C_1$-$C_{10}$ alkyl. 2'-modified nucleosides may further comprise other modifications, for example at other positions of the sugar and/or at the nucleobase.

As used herein, "2'-F" refers to a nucleoside comprising a sugar comprising a fluoro group at the 2' position of the sugar ring.

As used herein, "2'-OMe" or "2'-OCH$_3$" or "2'-O-methyl" each refers to a nucleoside comprising a sugar comprising an —OCH$_3$ group at the 2' position of the sugar ring.

As used herein, "MOE" or "2'-MOE" or "2'-OCH$_2$CH$_2$OCH$_3$" or "2'-O-methoxyethyl" each refers to a nucleoside comprising a sugar comprising a —OCH$_2$CH$_2$OCH$_3$ group at the 2' position of the sugar ring.

As used herein, "oligonucleotide" refers to a compound comprising a plurality of linked nucleosides. In certain embodiments, one or more of the plurality of nucleosides is modified. In certain embodiments, an oligonucleotide comprises one or more ribonucleosides (RNA) and/or deoxyribonucleosides (DNA).

Many other bicyclo and tricyclo sugar surrogate ring systems are also known in the art that can be used to modify nucleosides for incorporation into antisense compounds (see for example review article: Leumann, Bioorg. Med. Chem., 2002, 10, 841-854). Such ring systems can undergo various additional substitutions to enhance activity.

Methods for the preparations of modified sugars are well known to those skilled in the art. Some representative U.S. patents that teach the preparation of such modified sugars include without limitation, U.S.: 4,981,957; 5,118,800; 5,319,080; 5,359,044; 5,393,878; 5,446,137; 5,466,786;

5,514,785; 5,519,134; 5,567,811; 5,576,427; 5,591,722; 5,597,909; 5,610,300; 5,627,053; 5,639,873; 5,646,265; 5,670,633; 5,700,920; 5,792,847 and 6,600,032 and International Application PCT/US2005/019219, filed Jun. 2, 2005 and published as WO 2005/121371 on Dec. 22, 2005, and each of which is herein incorporated by reference in its entirety.

In nucleotides having modified sugar moieties, the nucleobase moieties (natural, modified or a combination thereof) are maintained for hybridization with an appropriate nucleic acid target.

In certain embodiments, antisense compounds comprise one or more nucleosides having modified sugar moieties. In certain embodiments, the modified sugar moiety is 2'-MOE. In certain embodiments, the 2'-MOE modified nucleosides are arranged in a gapmer motif. In certain embodiments, the modified sugar moiety is a bicyclic nucleoside having a (4'-CH(CH$_3$)—O-2') bridging group. In certain embodiments, the (4'-CH(CH$_3$)—O-2') modified nucleosides are arranged throughout the wings of a gapmer motif.

Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds. Modified nucleobases include synthetic and natural nucleobases such as, for example, 5-methylcytosine (5-me-C). Certain nucleobase substitutions, including 5-methylcytosine substitutions, are particularly useful for increasing the binding affinity of an antisense compound for a target nucleic acid. For example, 5-methylcytosine substitutions have been shown to increase nucleic acid duplex stability by 0.6-1.2° C. (Sanghvi, Y. S., Crooke, S. T. and Lebleu, B., eds., Antisense Research and Applications, CRC Press, Boca Raton, 1993, pp. 276-278).

Additional modified nucleobases include 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH3) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine.

Heterocyclic base moieties can also include those in which the purine or pyrimidine base is replaced with other heterocycles, for example 7-deaza-adenine, 7-deazaguanosine, 2-aminopyridine and 2-pyridone. Nucleobases that are particularly useful for increasing the binding affinity of antisense compounds include 5-substituted pyrimidines, 6-azapyrimidines and N-2, N-6 and O-6 substituted purines, including 2 aminopropyladenine, 5-propynyluracil and 5-propynylcytosine.

In certain embodiments, antisense compounds targeted to UBE3A-ATS comprise one or more modified nucleobases. In certain embodiments, shortened or gap-widened antisense oligonucleotides targeted to UBE3A-ATS comprise one or more modified nucleobases. In certain embodiments, the modified nucleobase is 5-methylcytosine. In certain embodiments, each cytosine is a 5-methylcytosine.

Conjugated Antisense Compounds

Antisense compounds may be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Antisense compounds can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acid from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy abasic caps. Further 3' and 5'-stabilizing groups that can be used to cap one or both ends of an antisense compound to impart nuclease stability include those disclosed in WO 03/004602 published on Jan. 16, 2003.

In certain embodiments, antisense compounds, including, but not limited to those particularly suited for use as ssRNA, are modified by attachment of one or more conjugate groups. In general, conjugate groups modify one or more properties of the attached oligonucleotide, including but not limited to pharmacodynamics, pharmacokinetics, stability, binding, absorption, cellular distribution, cellular uptake, charge and clearance. Conjugate groups are routinely used in the chemical arts and are linked directly or via an optional conjugate linking moiety or conjugate linking group to a parent compound such as an oligonucleotide. Conjugate groups includes without limitation, intercalators, reporter molecules, polyamines, polyamides, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins and dyes. Certain conjugate groups have been described previously, for example: cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al., Ann. N.Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., do-decan-diol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim Biophys. Acta, 1995, 1264, 229-237), or an octadecylamine or hexylaminocarbonyl-oxycholesterol moiety (Crooke et al., J. Pharmacol. Exp. Ther., 1996, 277, 923-937).

For additional conjugates including those useful for ssRNA and their placement within antisense compounds, see e.g., U.S. Application No. 61/583,963.

In Vitro Testing of Antisense Oligonucleotides

Described herein are methods for treatment of cells with antisense oligonucleotides, which can be modified appropriately for treatment with other antisense compounds.

Cells may be treated with antisense oligonucleotides when the cells reach approximately 60-80% confluency in culture.

One reagent commonly used to introduce antisense oligonucleotides into cultured cells includes the cationic lipid transfection reagent LIPOFECTIN (Invitrogen, Carlsbad, Calif.). Antisense oligonucleotides may be mixed with LIPOFECTIN in OPTI-MEM 1 (Invitrogen, Carlsbad, Calif.) to achieve the desired final concentration of antisense oligonucleotide and a LIPOFECTIN concentration that may range from 2 to 12 ug/mL per 100 nM antisense oligonucleotide.

Another reagent used to introduce antisense oligonucleotides into cultured cells includes LIPOFECTAMINE (Invitrogen, Carlsbad, Calif.). Antisense oligonucleotide is mixed with LIPOFECTAMINE in OPTI-MEM 1 reduced serum medium (Invitrogen, Carlsbad, Calif.) to achieve the desired concentration of antisense oligonucleotide and a LIPOFECTAMINE concentration that may range from 2 to 12 ug/mL per 100 nM antisense oligonucleotide.

Another technique used to introduce antisense oligonucleotides into cultured cells includes electroporation.

Yet another technique used to introduce antisense oligonucleotides into cultured cells includes free uptake of the oligonucleotides by the cells.

Cells are treated with antisense oligonucleotides by routine methods. Cells may be harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPOFECTAMINE. Antisense oligonucleotides are used at higher concentrations ranging from 625 to 20,000 nM when transfected using electroporation.

RNA Isolation

RNA analysis can be performed on total cellular RNA or poly(A)+ mRNA. Methods of RNA isolation are well known in the art. RNA is prepared using methods well known in the art, for example, using the TRIZOL Reagent (Invitrogen, Carlsbad, Calif.) according to the manufacturer's recommended protocols.

EXAMPLES

Non-Limiting Disclosure and Incorporation by Reference

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Antisense Inhibition of the Antisense Sequence of Ubiquitin Protein Ligase E3A (Ube3a-ATS) in Primary Neuronal Cells Antisense oligonucleotides were designed to target the MBII-85 snoRNA of the mouse Ube3a antisense sequence. As used herein, the mouse Ube3a antisense sequence is the complement of GENBANK accession number NT 187035.1 truncated from nucleotides 20128178 to 21349207, herein referred to as SEQ ID NO: 1. The MBII-85 snoRNA region is found within nucleotides 545131 to 776518 of SEQ ID NO: 1. The MBII-85 region comprises many repeats, and each antisense oligonucleotide in Table 1 targets a repeat sequence; thus, each antisense oligonucleotide in Table 1 has multiple start and stop sites within the MBII-85 snoRNA region of SEQ ID NO: 1. The antisense oligonucleotides described in Table 1 were tested for their effects on downregulation of the Ube3a antisense transcript in vitro.

The newly designed chimeric antisense oligonucleotides in Table 1 were designed as 5-10-5 MOE gapmers. The gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate or phosphodiester linkages. All cytosine residues throughout each gapmer are 5-methylcytosines.

Primary cortical neurons were isolated from embryonic day 14 CD-1 mice (Charles River) and grown on poly-D-lysine coated cell culture plates in complete medium (Neurobasal medium supplemented with B27, GlutaMAX, and antibiotic/antimycotic). The next day, 10 µM of an oligonucleotide listed in Table 1 or PBS was added directly to the cell culture medium. Three days later, cells were washed in 1×PBS and lysed in RLT buffer (Qiagen). RNA isolation was performed using RNeasy 96 plates (Qiagen). One-step qRT-PCR of the Ube3a antisense transcript ("Ube3a-ATS") was performed using the EXPRESS One-Step SYBR GreenER qRT-PCR Kit (Life Technologies) for SYBR qRT-PCR. Ribogreen was used for normalization. The results are presented in Table 1 as the percent of normalized Ube3a-ATS expression relative to the PBS treated control. As shown in Table 1, the antisense oligonucleotides reduced Ube3a-ATS expression to less than half of the expression in PBS treated control cells.

TABLE 1

| ISIS No. | Sequence | Ube3a-ATS (% PBS) | SEQ ID NO. |
|---|---|---|---|
| 705095 | $^mC_{es}$ $T_{eo}$ $G_{eo}$ $G_{eo}$ $G_{eo}$ $A_{ds}$ $A_{ds}$ $T_{ds}$ $^mC_{ds}$ $A_{ds}$ $T_{ds}$ $^mC_{ds}$ $A_{ds}$ $T_{ds}$ $A_{ds}$ $G_{eo}$ $A_{eo}$ $Te^m$ $^mC_{es}$ $^mC_e$ | 47 | 2 |
| 705096 | $T_{es}$ $G_{eo}$ $A_{eo}$ $^mC_{eo}$ $T_{eo}$ $G_{ds}$ $G_{ds}$ $G_{ds}$ $A_{ds}$ $A_{ds}$ $T_{ds}$ $^mC_{ds}$ $A_{ds}$ $T_{ds}$ $^mC_{ds}$ $A_{eo}$ $T_{eo}$ $A_{es}$ $G_{es}$ $A_e$ | 41 | 3 |
| 705097 | $G_{es}$ $T_{eo}$ $T_{eo}$ $T_{eo}$ $G_{eo}$ $A_{ds}$ $^mC_{ds}$ $T_{ds}$ $G_{ds}$ $G_{ds}$ $G_{ds}$ $A_{ds}$ $A_{ds}$ $T_{ds}$ $^mC_{ds}$ $A_{eo}$ $T_{eo}$ $^mC_{es}$ $A_{es}$ $T_e$ | 30 | 4 |

TABLE 1-continued

| ISIS No. | Sequence | Ube3a-ATS (% PBS) | SEQ ID NO. |
|---|---|---|---|
| 705098 | $A_{es}\ A_{eo}\ T_{eo}\ G_{eo}\ T_{eo}\ T_{ds}\ T_{ds}\ G_{ds}\ A_{ds}\ ^{m}C_{ds}\ T_{ds}\ G_{ds}\ G_{ds}\ G_{ds}\ A_{ds}\ A_{eo}\ T_{eo}\ ^{m}C_{es}\ A_{es}\ T_{e}$ | 35 | 5 |
| 705099 | $A_{es}\ G_{eo}\ G_{eo}\ A_{eo}\ A_{eo}\ T_{ds}\ G_{ds}\ T_{ds}\ T_{ds}\ T_{ds}\ G_{ds}\ A_{ds}\ ^{m}C_{ds}\ T_{ds}\ G_{ds}\ G_{eo}\ G_{eo}\ A_{es}\ A_{es}\ T_{e}$ | 39 | 6 |
| 705100 | $^{m}C_{es}\ ^{m}C_{eo}\ A_{eo}\ A_{eo}\ G_{eo}\ G_{ds}\ A_{ds}\ A_{ds}\ T_{ds}\ G_{ds}\ T_{ds}\ T_{ds}\ T_{ds}\ G_{ds}\ A_{ds}\ ^{m}C_{eo}\ T_{eo}\ G_{es}\ G_{es}\ G_{e}$ | 32 | 7 |
| 705101 | $T_{es}\ T_{eo}\ T_{eo}\ ^{m}C_{eo}\ ^{m}C_{eo}\ A_{ds}\ A_{ds}\ G_{ds}\ G_{ds}\ A_{ds}\ A_{ds}\ T_{ds}\ G_{ds}\ T_{ds}\ T_{ds}\ T_{eo}\ G_{eo}\ A_{es}\ ^{m}C_{es}\ T_{e}$ | 34 | 8 |
| 705119 | $A_{es}\ G_{eo}\ T_{eo}\ G_{eo}\ G_{eo}\ ^{m}C_{ds}\ G_{ds}\ G_{ds}\ T_{ds}\ A_{ds}\ ^{m}C_{ds}\ A_{ds}\ G_{ds}\ A_{ds}\ G_{ds}\ T_{eo}\ T_{eo}\ T_{es}\ T_{es}\ ^{m}C_{e}$ | 41 | 9 |
| 705120 | $A_{es}\ G_{eo}\ A_{eo}\ G_{eo}\ T_{eo}\ G_{ds}\ G_{ds}\ ^{m}C_{ds}\ G_{ds}\ G_{ds}\ T_{ds}\ A_{ds}\ ^{m}C_{ds}\ A_{ds}\ G_{ds}\ A_{eo}\ G_{eo}\ T_{es}\ T_{es}\ T_{e}$ | 36 | 10 |
| 705121 | $T_{es}\ G_{eo}\ A_{eo}\ G_{eo}\ A_{eo}\ G_{ds}\ T_{ds}\ G_{ds}\ G_{ds}\ ^{m}C_{ds}\ G_{ds}\ G_{ds}\ T_{ds}\ A_{ds}\ ^{m}C_{ds}\ A_{eo}\ G_{eo}\ A_{es}\ G_{es}\ T_{e}$ | 37 | 11 |
| 705122 | $^{m}C_{es}\ G_{eo}\ A_{eo}\ T_{eo}\ G_{eo}\ A_{ds}\ G_{ds}\ A_{ds}\ G_{ds}\ T_{ds}\ G_{ds}\ G_{ds}\ ^{m}C_{ds}\ G_{ds}\ G_{ds}\ T_{eo}\ A_{eo}\ ^{m}C_{es}\ A_{es}\ G_{e}$ | 28 | 12 |

Subscripts: "e" indicates a 2'-methoxyethyl (MOE) modification, "d" indicates a 2'-deoxynucleoside, "s" indicates a phosphorothioate internucleoside linkage, and "o" indicates a phosphodiester internucleoside linkage. Superscript "m" indicates a 5-methylcytosine modification.

Example 2: Dose Response Inhibition of Ube3a-ATS Expression and Induction of Ube3a mRNA Expression Antisense oligonucleotides selected from Table 1 and a non-targeting control antisense oligonucleotide (ISIS No. 141923, $^{m}C_{es}\ ^{m}C_{es}\ T_{es}\ T_{es}\ ^{m}C_{es}\ ^{m}C_{ds}\ ^{m}C_{ds}\ T_{ds}\ G_{ds}\ A_{ds}\ A_{ds}\ G_{ds}\ G_{ds}\ T_{ds}\ T_{ds}\ ^{m}C_{es}\ ^{m}C_{es}\ T_{es}\ ^{m}C_{es}\ ^{m}C_{e}$, SEQ ID NO: 13) were used in a dose response study in vitro. The protocol described in Example 1 was used except that various antisense oligonucleotide concentrations were used and both Ube3a-ATS and Ube3a mRNA expression were analyzed. The results, shown in Table 2 below, indicate that the antisense oligonucleotides inhibit Ube3a-ATS expression and induce Ube3a mRNA expression relative to PBS treatment in a dose dependent manner, whereas the control oligonucleotide does not have any effect.

TABLE 2

| ISIS No. | Dose (nM) | Ube3a-ATS (% PBS) | Ube3a mRNA (% PBS) | SEQ ID NO. |
|---|---|---|---|---|
| 141923 | 39 | 0.8 | 1.0 | 13 |
|  | 156 | 1.0 | 1.0 |  |
|  | 625 | 0.9 | 0.9 |  |
|  | 2500 | 0.9 | 0.9 |  |
|  | 10000 | 1.1 | 1.0 |  |
| 705098 | 39 | 0.5 | 1.4 | 5 |
|  | 156 | 0.4 | 1.5 |  |
|  | 625 | 0.4 | 1.5 |  |
|  | 2500 | 0.4 | 1.6 |  |
|  | 10000 | 0.4 | 1.8 |  |
| 705120 | 39 | 0.7 | 1.2 | 10 |
|  | 156 | 0.5 | 1.4 |  |
|  | 625 | 0.5 | 1.4 |  |
|  | 2500 | 0.5 | 1.7 |  |
|  | 10000 | 0.4 | 1.8 |  |

Example 3: Antisense Inhibition of Ube3a-ATS Expression and Induction of Ube3a mRNA Expression Antisense oligonucleotides selected from Table 1 were used to test up-regulation of Ube3a mRNA in vivo. Each mouse received 500 µg of antisense oligonucleotide or PBS via intracerebroventricular injection. Each treatment group consisted of 2-4 mice. Two weeks after the injection, the mice were sacrificed and RNA was isolated from the spinal cord for qRT-PCR analysis, as described in Examples 1 and 2. The qRT-PCR was performed as described in Examples 1 and 2, except that Ube3a-ATS expression was measured using primer probe set: forward primer: 5'-CATCCAGA-GAAAGTGTCACCA-3' (SEQ ID NO: 14); reverse primer: 5'-CTCCAACTCATCACTGTAGGTATC-3' (SEQ ID NO: 15); probe: 5'-AGCTCATTCAGATATCATCAACTTTT-GTCCAGT-3' (SEQ ID NO: 16). The results, shown in Table 3 below, indicate that the antisense oligonucleotides up-regulated Ube3a mRNA expression in the spinal cord and down-regulated Ube3a-ATS expression in the spinal cord.

TABLE 3

| ISIS No. | Ube3a-ATS (% PBS) | Ube3a mRNA (% PBS) | SEQ ID NO. |
|---|---|---|---|
| 705097 | 21 | 165 | 4 |
| 705098 | 35 | 159 | 5 |
| 705099 | 63 | 167 | 6 |
| 705100 | 26 | 162 | 7 |
| 705101 | 24 | 142 | 8 |
| 705119 | 17 | 196 | 9 |
| 705120 | 40 | 141 | 10 |
| 705122 | 51 | 139 | 12 |

SEQUENCE LISTING (16 sequences)

SEQ ID NO: 1 - DNA, 1221030 bp, Mus musculus
  misc_feature (592660)..(642659): n is a, c, g, or t
ttattctatagatctcaagtctttagctgaagaatcagatgagaaagctatgagatcaggacctggcttcctttgtcctgtcctgtgttgtgttgtctgcagtgcccctccccttcatgcttcaatctgccctgtcacatcagctcagttctcttacagggtgaacattaacatttcaaagagctgacagtactgtggattattggtgtgtaggacaaactgcagtcaggaagaaaaaaagaacaattatatttacagggatgtttcataaaaataatattcctaagggaatttaagtcagattctgctgtgccctgaaggatgggaagggattaaagcacttgagggttaacatagagattatcatcagagggaagacacaacagataatggtaggtctcagttttgggatggaaaggatcatcaggtacatatgacttttgacactatgatacctataacacaggaatgaagagtccaaagtggctttaagaaagagtagtggagagtaaattcaggtgtgtgaactaccaacatatgaaaagatgggatatctttcacacacacacacacacacacacacacacacacacacacacgtatacagtagtagagaataaacctttttttctgtgatttcataatgtaatctaatttgaatgtttacagtcctttagtgtctttatatatttgttatttattattattattattattattattattattattattttgttatgttgttcagattaaacaataaactagtgaattagtaagaactttctttggatatataatgtatttctttattttgctttgtcccttgattttactgaagtttatagatattcaaaatagcatggtgattttttgttcattttccatcagataaataggaaagagtgtgtgttgtcttttgtttttgtttttgtttgtttgtttgtttgcaggtgtttttgtaagtgtattttgtttttcattataaaatggtgttgtattttatttttattgaaaattaattttaacacaataaattacagttttctctttttccttctcctcccagttcctccctacctccctttccttctaggtccaatccctttctgtctttcattagaaaagcacatccaaatgatagcaactaaacatagcaaaatgaaatataataaaataaaccaaaaacataatgttgtgggtggagaatgcaacctgatagaaggaaaagtaccacaggagcaggcacaagcataagagacacattggttaacacattcaggaatcccacaaaaacactaaactgaatgttatagcatatgtatagaagacccagtgcagtctattgtaggctcctgaacagagaggtacaaagagctatgtcctttcgcaggtatcatatatgtttgtatgtgtgtgtgtgtgtgtatgtatgtatgtatgtatgtatgtatatatgtatgcaatttatatatacatataattgatatataaataaataatttatatatgaatattatgtacattacaaataaaaatataacaatgttatgtataacataaatttatatatttatataatgtaaataatactttgtctatgatttctttctcaaactatttatgtcataaacataacatttcaggtttttttatcctggaattttgctggatgtggttattagcattatgcagtttctggtggcatatttagcacatttttttacttatagaatcatatcatatttaaattataattaattgatttcggcatttcctactcctatcgcctttatatctttccctcttgttgcttacctacgactcctaatactgtactgaataagacaggaagtgtgaccttccttgtcttgttcttaatttcaatgaaagtgctttgagtttctaatcatttactaggatgctatccctgagtttgattttcattgtcttattatgctgaaatatactctctttaccattatcagtgaccacatttctaaggaaactggacacttgctatcttagtagtattcgttactatagaaatgtctgcaggtagggttggaatatttagagcaccttcatccttccttcttgaatttgctcttgatcttcttggggtatatacatttaaccataacttttggaggtcatgtttaaacagtcatatcatttatagagaaaacatttctgagtacttctccaatcctctagcattcatttagtttccacaactttttccttaatattgtttgaccacagtacaggttttggatgtcccaaatataactgaataatgacagttccttattctcaggattttaagtagttattcacctttgtgctaatcaacaccaactctcataagagtctaatctactcaaagattcaccagcatgtaactatggcaataaacagaaatatttaaatggaagtttgataaaatgaccagttagaaaaataaaattagtatgttctctgctaagacctaaaaattcctttggcatgtttgataccagcatctgcagtatcattcctgaattctctcctgaagaacaggcattgatttctaatcaagactgtggttgattactcgagtaagtagtcttacaacagttgcactatgaatgcattggacctggcaggtcattaatgtagcatgaaaagtttagtgatggataagaaaattattaattttaaactacttagaaaatgcagagagacattttctagcactataaagacagccagcatggaaagattcctgggtagttaaatgtgggtttctccatcaaacaatatgtatagtgtaaggcatataacatgtcttaccatgaagttcacatggggcaattgagaaaatgcgtgattgttggtacatgctttctaggattctttgacttttcttttttattattaattattttaattatttactttccaaatgttagatcccttcccacactcccctacacaagcacccaaccccaccgacttatcatctaagcctctaagagagactctcctatacacccacccactcctgcctcacacctctcacatcacccttcaatggggcatcaatcctccacaaaaccaagagcctcccatcccattgacaaaaaatgagataatcctctgctacatatgcagctggagccatggaatcacccatctttactctttggttggtgggttagtccctaagaggtataaagcatctggttaattgacattgttgttcttcccatgggcttgcaatccccttcagctccttcagtccttcctctaactcttccattagggttcttcgggctcagtccaatggttgactgtgaggatctgcatctgtcttagtgaggttctagaagagtgtctcagaggacagctactgctgtcaacaatcacttcttggcactagcaatagtgtcagggtttggtgtctgttgatggaatggataacagggtgggacagtcactgtatggactttccttcagcctttgctccatttttttgtccatgcatttcctttcgacaggaacaattctgggttaaagaatttgagatgggtggatggtcctattcctcaactaggggccatgtctatctactggatatggtcttttcatgttctatctccctagtgttgggtattttggctaattgccacagacaatctgggtccctggtctgtgaagaacgggatttcttaggcagatggacaaagattccggatgaaaatgacagacagatacacgaaagatgtgttgaatctgaatgtaatgttctggttgagcttcagacttatataacaacgaattatcagaagatacaaatcacaaaaagacaagatacactgaaattcaccagttacagcagaaaggaatttacagggactaattaaatgtttacattagggataacaagccctgcctaggatcagcctaatgccaggcaagaatttcacactttaaggttaaaagcatcagggggttgttaactcttgacaggccttaagagtaatgcactatcacagagctctaaattcttaggtctagtaaaacttatcttgtctggagagtttccccttatcagggtagtatatcaacttatacttgacatggaagtagcctgtagtaaaagatttctatctcagtgagacttttagtctctatctgtaaacagctgagtaaaatggcaagtgcttaattgtttactgaatgggttaagctccttgctgctatctggaatctaagaacactggaaaaaggctttagctatgttagaatacaatcttaaaaggcatttactataaggtaatactatatagagtgcacgtggatctatacactagactaatgtgggaatggaaaaattaattttatggtttatatagattagggagaaaatgccaggcccccgggaagggagtttccttgaaactctttgcttcatgaaccagcttcccagctttcgctttgtcaagctgactccaccagagtccctggcagctaatgtcatccttattgggtcctaggagcctctcacaaccctggcatctgggactttctagtgggccccctgtaccctccccctgctacacatttctattcattctcctgatcctctggatttctaccctgtttcttctcataccacaaacctgattctgctaacctccctttccctccctcaccaagttccctccttccctctgcctcccatgattattttatttcactttctaaatgcaattgcagcattcacacgttggctttccttcttgttaagcttcatacaatctgtgagttataccatgggagttctgagattttgggctaatatccacttatcagtgagttcaaaccatgtatatcctttggggtctgggttacctcactcaggatgatattttctagtttcatccatttgcttataaaatgcataaaggcattgtttttgatagctgagtagtattccactgtgtaaatgtaccatgattttttttgtgtacattcttttgttgagggatgtcttggttgttgccagtttctggatattacaaataaggatgttataaacataacagtacacatgtactttttatatgttggagtatcttttgtcctcatgtagaaattgctagtcttttaaggaactagaaatcactttggaacgttatttccaaagtgattgtaccagtttgtaatcccaccaacactgaaggagtatcctgaaacacatggtacagacttatatgtgaattattctctctctctctctctctctctctctctcacacacacacacacacacacacacacacacacacacaaacacacagagcctacagattccataagataaatcataaacacggaagagggtcacacaaatctaaatacttcggccttgtgaataccagaaatctcccttacatctgagactgaacaagaaataaaaactcaaggctagttatcagatctacttatcacaaacaatctccatgaaaattgccacaactaaggatgagggacatctaagttctttccagcattcggctattattaataaggctgctatggacatagtggagcatgtgtccttcttatcagttggaatatcttctggatatatgcccaggagaggtattgatggatcctccggtagtactatgtccaattttctgatgttcttttatcattgagaagagtttttgctatcctaggttttttgttataccagatgaatttgcagattgccctttctaattcgtcgaagaattgagttggaattttgatgggaattgcattgaatctgtagattgtttttttgcaagatagccatttttattatattgatcctgccaatccatgagcatgggagatttttccatcttctgagatcttctttgattttgttcttcagagacttgaagttcttatcatacggatctttcacttccttagtttgagtcacactaaggtattttatattatttgggggtattttgaagggtgtggttcccctaatttctctttacgcctgtttaggatgtttatcgctgggatttcatgtccagaatctgggggaagatcagagattgttgagattgcatgtaatgagcatatgcttttcattctctagagaaggtgctcgttctggctgtgagaggttgagaatgtttggtagttagaatctggtagtagaaggtcctcagggaaggggtctgaacattagtaagctagaagaatttacaataactattcctagatctgtcatcaagaattaacagataactaagtacttttattatgtggactgcatttagtgatttttggtgctatttactctgtgccactcaatgcaggtattctattttccacagccaatacaaagaaataaaggaagtgttggaaagatgtgtctcacctcaaaccaaaaaattttctacagaaaagaagattaacataagaacttagataaactttcccttacagcatatggaaataaatatttagaaactaggttttagggaatgatggtcaaattaagatgttaaaaattgatgattattgtataaatgtgaaaaatctcttttcatacaaatatacaagaggattctacattgtaacaagttatataaaatcttaaaccaagcttataatctatgttatagatgtgttatcatactccataacctgaaaatatgcctctattagatacatcacaaatatacatggtcatatttagtgtgagaaatgaaccacagtaaatcagagcaaggaaagagaatctgtcagtgacaaatagaactaagtgacttaaactttctaatgattaaaaaaaatatggcatatatatgacatatagaaacttctagttctgcagttttctgaagttttgactcttatgaaaaactacttttgcttggtggatgttataataccttattggtattagaagtgttgtctctccacatattaaattgtcttcatattaaaataactgtggaccttgtcttggtagtttccagttagttctcaccaactttaaattaacaagggaaggggagataaggaaggtggaatggaaggtcagagtgtgagtgcgggcaggagagtacatcaaatcattactgaaagtactttatcactcagagattcagagtcattagtggcaaacaagaccctattgtagaataaaggtgtgataggacatggcccaggaaacagaggcttgtttccttgcatccttaaaacctctctacccttccctcacatttgatgaacatggtagggctgaatcaaactgatcatccttgctcagagttaatggccaaggaattttgaatgtggtctattgtacagaaacatcaggaagagtctttgtatcaaagtattctggtttgaaactgcaactatagttatagcatttcactcatcacatagttttttgaaatcactacctgggcaacccctttgcagggagtaaatataccttacttagtggggaatatgattgcccacctctggctcaggattaatcttctgcacctgtaatttatattggatgtggtaaggaaagaccctcacaactatctgcaagtggagtttggctactttgctttgagttcttagaaagtcacaggtgcacaccctaccatgagctatctcagatttgcagatcacacacacacacacacacacacacacacacacacacacacacacacacacaagttcatttttaaactgccttattggctctttggctgggctcttctatgccttccttggctagtatgctcttatcttttctccttgctcaacacctctaactcttccctcaatatagctgctcagttacctttactcctacctagctaaacacctctaaatctgccctcaacttagttgtccaactgctcatactcctatctcaacatctctaaggacccttggtcctgagaagatttgaagctccagagtaaggggatactggaggggtcgggtgggagatgatgggtgggtgggtgggtgaataaccttatagagagcacaggagagtgaagggagggaggttgtggattggagagcttgtggagggggaacctggaagtgggatatcatttgagatgaaaatgaattgaatgattaattaaaaaaaaacaatagaaaaaaatgttggaatggaaagtggtgtttttatagtcccaagccattggctgaatatcagtttcttctgtctctggtccagacctctttctctttttagtaggttatagtagagcccttgccaaagcctggagtcagctcagaactggactcccactaggaacctgagtgacaaagtcctgtgttcagggatgtgtgttaactctcatgacctctgattccttcagtctttgcctgaaaataaaaacattaaagaccaaccagaagaaagatctgatatttaggaatgaaaagcaaatgtgtgctataacaaaggagatctctttcagaactactgtttcatcttgttcttccttcttgtatatagcaacaaaggtgtgtgtgtgtgtgtgtgtgtgtgtgtgtgtgtgtgtgtgttgaaacactttgaaatatctgctcaactgttctaaagaagtatcgggtgatcacaaaaaagtcacaaaaatgagattataatgccaagtaatcaaaacctaagacaatgggagaaaatgtaatccattattaacaaatatattctccacagatctatgggtaaagaaattacaaaatgtgaactaatgtcttcataatcttcagtcattcttttttatccattctactttgatatattgaatctttttcatgaaatatttctcccttccctcccatttgatgaacatggtagggctgaatcaaactgatcatccttgctcagagttaatggacacatcaatattggttagtgtttgctgaaccttacaaggaacagtcataccaccctgtccagtcagcaagtgcctcttggcaactgcaacaatgtcaggtttgttgtctgcagacagggaagatccccaggtgaggcagccctcggatggcccacccttcagtctctgctccatttgttgcctctgttcatgtgaatttctttgtgtcagtgttaccttacacaggatcataatttctagttccatccacttgcctgtgaattctgtgaatacattgtttttaatagctgagtagtactctggtgtgtaaatataccacattatatgtatccattcatgtgttgagggacaaccgggttgtttccaccttttagctttataaataaggctgctgtaaacacgaaggatcatttgtccttgttatatgttggggcattttttgtgtgtgtttatgctcagtagctgtgtctacatgtagaactatttccaaatttctgaggaatcaccagactgatttccagaatggttgtacaacttgcaaccccaccagcaatggaggagtatgatttcattgctggacatttgtttttgacaaataaacaccagtgtggctttaaaatctgtcattaatgagaaggcttgcagtcctgcttcatctgctagaaaggcaattcacttaagccttcggtgtctgacaagaacaggacacctgatgctcctcacacaccttcacataataaatgaagaattttgtcaggaacagctttctgctggcattttgagacttcctcgtggcttaagtcatattctttcctaaattatctctcctgtgacacagagatttctgagagcaaagaatgataatatttacattctctttttttgtgaccctattaccatcagttgtctttttaaatatttttattacataatttcctcaattacatttccaatgctatcccgaaagtcccccacaccctcccccgccacttccctacccacccattcccatttttttggccccggcgttcccctgtactggggcatatacagtttgcgtgtccaatgggcctctccagtgatggccgactaggccatcttttgatacatatgcagctagagtcaagagctccggggtactggttagatccccttagctccttgggtactttctctagctcctccattgggagccctgtgatccatccaatagctgactgtgagcacccacttctgtgtttgctaggccctggcatagtctcacaagagacagctacatctgggtcctttcgataaaatcttgctagtgtatgcaatggtgtcagtttttggaagctgattatagggtagttgtcttagttcattcttccttcttttcctccattcataaaatttattgcagttggtatacggtttaaaagttcaccaacacacaaatagtactaaattaaaccacattatacagtattctccctcgggaaacaaagcatactatgattgtcaaagctagatgtcagtctaagatttagaaaaaggaagaatgtgaacctaagaaaaaagaaaaagaactgataatgacaacaaaaaatccaaaaaagcctgttttgaacattgattgtctcctctaaattaaaagattattttagcataaactgtattaaagacaaactagaaactcttcaagtaactaaagataatgctccaaggccattttcacagtttcttttgtttgtttatttgcttgttttaaattacattacagccaaattcacatacatctgatgaaatatttccaaagcagtccagaaacacacaatggggttttccattcagtatcttaagagcaaaaataggctatatttacagtagttaaggcaatcaaattttaaacaaaagcaattaaaaaaagaaaaagggaaaaattgttttttcacgctactcccttagatcttatttgtaattgcaagacaggaaaacagtgtgcaaaatgcttctcccctgcacactgggcatcagaatcacacatggggctgcagcctcttctgctggtacacagtcgactatcccactttcccatgtcaatcaagacagttcaatcctttcagcctgcgcctttgttttcagtctatagaatcttttcatgacttagtggatagtgagaaggaaataaaataggggaggaaaaaagggaagtaaaaaggaggaagagagagagaatgacctataacctattgttaaatgatgcattagttattcaaaaaacactcagttggttacatgtgcacacctaaaccctgagctggtatgggttctatgcaattacaagtctggtatgaatgcacgctgcacatgcaattctttaagccatttgtaaacatttatatgttccttcctagtaatatattgaagttatcaattttcaggttaatttattattcagcttaacagtttcaaacttaaagatatgggaaaagtaaattggaaagtatataaagtaaaaataaaaacagtgcatttatatgcttcataacaccagtttttttcaaatgagactacttttctaaggaaattaaatagttttaaactcactcattaaagttttacaatgtaaattaagacaaaaaatatactgaaactcatgcatttctgtggtgttaatatttacttttcaagactcaactaaatccatcaacacaatacaccctcctagcccttataattaattacagtacccaagagtagtaattcatattacagaattagtttgtacttctaactccggttctatccccagttatatgatgtttctgtgctgtctctaataataatttccagtttttcaccctgacattgtaacccttttcagtctttgagaacacataatgtaagaagctgatccatattcccaatggggggcaggaaacttggcctgccacgtatttctttattattttgaatttcaatctccaggtactgatcaaggtttatcagtgtattttccaccatgcaattcagtttgttatgccaggtgtgttagtttagttatattgcttcttttgaactcttttgtggcacagccattttcactatagtgaggagaataatgaagccactagagctgcttaacacagctctaccaaagctaagtagatttctacaatcattgttctatccccaacttctgggatttggtctcggtgtgctgcattactggacattctgcatgatggatcattttatgtcttttcctgtgaaaaaaatatctgagtctttttaggaaaatccttaaattaactttctctggccactatttgaatgtatcctttatgcccggctgatcattaagcacacataaacacatagctccataatgcctttactctaggagttttcttgtgatatataactgtgagtgaacttaaacagtgtagttaatgcagagtagagatcaactctgacttgccaggagaataggttacagatttaagatctctttttaatattcttagaggtctctataaatgtacttaaaaatagggagtctgacagtatacattcctgaatgagtaaaactcaataaataaaatagattaaatgcattctgacatggtatctgagttcatatatgcatcagtcatgtgtctatgagacgtcctctacttggtgacatggactacctctggaacttactagtaatctttctaattacttttgttcagagatatctgtgtacttttaagtgctcagagtgtcttgtgttcaggacattgttcttgttgtgtatctttatttcaagagtatatattccaagaagcttccctgatattgtggatcaatgaactgactttttctcttcttacactgaggtagcaatttgattaaatatattaaatgtatttttatatttgaccataaatttcaattaatattttatcacattttatcaaattttacataaaacactgtaactttatcagtgaaactggaagaaacattaaaaattgtcttagaagcaatagtgtaatatatgatggcaaaggagacagataccgttctcaatgttactatcttttagtattcacacaggtgattgcttacatacccattagctcttcaaaatgtaccatagctatcatagcttgcaaggaggctgtactagagaaaaagtactttcaaccaagaagtcctgtgggattgtcattttaattaatttttattttaaatcaatttattctctgaaaatttgtacatttataaattggatctttatcatatctactctcattccatatctagtctccccttaaaacattttcctcccaatccatgccctccttttacagtaaatacatcatttatgtataaataccaattactccaaatagtgttgtccttctatatttgtggtattacaaccaagaataaagctaccaacatgttcaatctggtagtgaaatagaagagattgggacagagtttatttttgaagagaaatgcaaatccttaatagtaaatgctcagtgtaatttggagtattcccaaagccgaccaggtatacttgcctaaaaatggttctgatttagagtttttcttaaaacctcatataatccaattcagataaagcctttagagtatgatttgctgcacaggtttcatgtactatatcatgtagtcagttgacaaccatagttgacaacaactctttgtttgcttatttatttataacttgctttctttgttcatttttataaagcaagctgttatttccctattcctcatccacaattgttcaattcaagctgatggagatgcctataatcagagccatgatagcatagaagattgtgagaaagtgcatagtacaagatatgaggacctttttagaagtcaacatttccttcactggatagagttattgtaggtatattgtgtgaaacatttgatcttgaaatgatatacatacaaaagtctacctatcaccttacatagttattttagcagcacaaaaatgtcaaatttcacacatattcaataacatttgtgtgattgaagattactttgagattaaagcagcattttagttggttaaatgtacattattaggtcccaagtgttgatatattctatgaatttgattctctgtgagtcctgacattaggagttttattatttatttttccctagcatatcacaattttctagatatacatgattccactattacaaggagacagtttgttctgttcaaatattatcccgaaattctcagatactttaacaactttcacacccaacaaaaaggaaacagaggccaagtgacatacttagttcaatgacatatttacttaaatgtcttttagacgtttgtgtgatcttttgaaagttgcttagattagtacttccacatgagtagttattagcacagactgttctagaatgtcttcttacacatttgtatgtctttgacgtatggattttaggataggataccctgatagttattaaacaggcttgacaaaaataccaagaagaaaaaaagaaaagatgaaagagaaagggtaaaagagcctatgacgacaagttgtagcattttcagaataatataaatatcagagagatacattaggtaaagcctgaatatgtcactcttgtagagtccagtgaacaaaaatatttaagggctaggttttcaaaaatctctttaggcaggcaattatttgagcaagttccagactgtattgttaactccttaaagagtgatggtgtggatcaaaccaacagtgtggacagctctgagacaagaggccgcaagacaactgagttctgtccagaccaggttggagagtccttacaaatgtgtcttgctgtgcctttagatcacctaagttctctacctcactgaagctagaaggaacaagacttagtatgttgagatggggagaactgccatataagctgaactcctatttggtttctggattttctaggagttttccaatgatcttctattcaaaatggctaaaagtttggctcagcaaataagaaccttgagacctgtcacattatcatacttgttgtcaatttcttccatgcctgccagctacttcatgttgttgatgtaacatgcctaccagtcattgacacagaaaaataacttgaatgatagcacggacacactgactaataccctcttattttctgtatgtcatgatttttgttaagcttaagaaactctacaactgtaaacttcacttagtatccatcaaattaaaagtcaataagaactattatgtcttaaatagcttgagtcagggctgaccagaaggcagagctttgaacagctgcatatgagctcattgtgtgctttgtggttatggcacttgtaagctcacactgagaaatatttagggatgtatttttcagctcaagaaccttatatgtccctgagaaattagtctcagtgcgttccttcaaaaaattgtccctatctgactgaaatccgtgttcagctggtttgtgagcaacttctgtaccccaataggacatacttacttttgttcatggtgtaaatttctgaaaatgacaatttagatgcagtaatgggatttctgttttgtgacctctaagtatattgaagatactggaagttagcattgatatgagaagagatgaagtgagtatgttctttgtcctgtataaataagctagctttgtgtgaaaacaggaatgaaatgactctataatgctagtcattgtgaatgtagaaaatttctcactgagtattttgtggagaaggtgagagctgactgaaattttgagtattctaaaaatttagataagataataggaaaatgcatagattgaaaattgttctttatagcatgtagcaaacataaggagaatagcaactttcactgtgtcctattatatatgaaagaaagttgacaaaatcactcaatttcacagcagtgagtgttgtggttatcactaggcaataggctttttagctctccatgatcaactagagtgtccaggtccactatccttcaaagcaatcacatagatcccacttttcctcatgtgtgcttgtctatttcttgtcaccaaatgtttcctaaatcctgtgttggcctatattaccaggaacatggattgtataggcagtgtataaactttgtaacacttttggtgagtgtaaatgtagaagaaatttgtatctgcggtgggctgttctcatatctcaatgtgtattagaagtcagaaagcaacttgaacaattcagtttttatttctttacaatgtacagaacctggggaacaaatttttggcaacagcctctgtggaatgcaaatttactctctaaataatcttcctatcctggtgcactagtcaggacatcacctagaatcaccactgagctctacagaagcatcactagcaggggctagcctccagccaggcttcagtctgtaaatctgttgtccaaaactgcataactcactgttgtaggatatttgatcacgttatgaacacagatattgtgtaatttactgaaaaaatactctttcggattatggtgtcactaaacccttagcaaacaccctgaatccccttagtgtgcaccaaatactggatctgactttatttgacttaaagtacatgagatatcctacttagtctcagccatgatctttcatttttcttttgttgttttcttttggttttaataccagcttaccatgaatccccttcaatatgtttttatatacttttactgctctcactgaaacatttctaaagacctagctagggcaaggaatatggaaagacacaaagaaaggaaagccagaattagggcacttgtgatatgaaaatttctttgctgaggttaattttgccacacttcataaaatttagggcttcagtttacttaaccactataggaagactcacaaaaacagaaggacttcaaaccagagtgctaactaggtgaaattctgtaaggttatttttggagaaaatcaggtgcagtttgttgctaagttaaacacaaggatcccccgttatcttttgttcaatatcaaacagtttaaaacatgtccaacactaatgtacttgagttttactgtaagggaagactgtgagtttgatatggtcattaaagccacacatttgacagccatgctggtctttcaagatttctttgcagactcaactcagtaggaaagcatacaatgctgaatttccctctttacatttttctatgccaggataagatgtatatatgctatatatatagttattaaaagaaatgcatttcctcaatattattactatacataaatgttatataatgatatgcataaaatgcagactataggacattttatttaaaaaaaattccaaaaacaaaataatttactgcaatgtatatatacgaagaaggaaaactaaatgggttccacaagtttctgtgtgtgtatgtgtgttcatcacttcaatgcatgtcaagcatgttcattttcacccatatactcaatcatatgccaaaaaatgtgtcctgtttcaaatccaccatctacatattctatgaaaggaaagaagcacataatatactaaactgaagtaatgtttatttcatataaacaataaactgcagaatttagacagaactattaatctaaaaattttaaaagtgttctaagaatattccaaggtaccagtatataagaagttcataggaaatatctaatcattttcaaaaacacagcaaatgagatggataaaacagaataacatatcagagaatactgcagagacacctcacatacactttgtctatagtcattgcatattcatgggtgataattagcctgtgttccatttgtgacaatgtttgagaatcattgttgcaaatactacaacatatgttataatattctgcactccatcactagccacacaacaaaccttttttgttgaaattgtcaaattgtgaaatgtattcccaagagtttgtgaataccaagaatgaatgaactagggtttgtaacccccttatatacatggatataatgaaaaattatcagaccaattagctatctttagatacccatgaaaacctctaatgcagggattgagtcacatttaatttaattggcagacagtggggcttcaatgcaatcctcaaaccatccaaaaaatttttaatactctaccttgctctatccaaactgtcactaaggaaccattgatgaaaacagttcctctattgaaaacaaagttgctgagctggcaagggaagatacaaatgcctcacactattactgaggctatgaagtgctcaaaaaaggaatctatcatgactgccctctgaaagacccaacaaacacctgaaaagagtcagatgcagatatttgcacataatcaatggaaagaagcagatgacccctgttgttgcatttaggaaggctaaaagaaactgaggagaagggcaatcctgtagaagaactagcagtctcaatctgaactcccacaatctctcaaacactggactaccaaaaagacaacatacaccagctaatatgcagcccccaacacatatacagtagaggactttcgggtctgtgttcattcagagatggtgcacctaactctcaagagactgggggccccatggagtttaaaggcatatgtgatactttcaggcccattgtctagtagtttggtttgtagtagtcccaagattggagcaatcagcgaaagggagagagagagaaaaaaagagagagagagagagagagagaggccagtctcagagagagaacccaggctcagaggaaaagacaataagcatagaaatttaagatgttgattgacagaaatatttatctggaatatctatgaaatattatgctactgtaactaaaatattccatttgacttttttatttaaagtaacttgctttctgttcactgtacatagcatttatacaaatcttgagaaatctaagaacagtatgagatgagtagcagttatccctataataaatagtactatttttgctgatcttttcctgggctgtattattttgatccccttttttaaagtctcaagttgcaaaagtgatgcaggagagatattaggaaatttctcaataatcttgcttgtgttgaaagaatggagagctaaacaccaacttcagaaccataatttaataaactacagcatcataaaacactatttcaatattagccatagctaaaaggcacttaattcctgcaaaactgaaaccagtgtcctatagaggaaccagagaaaacagggaacaaagagagctcccatacatatgcatgctccagtagtgggcagtagtcattgagtagcaaggtaagcaagaaagacagcagctcctatgggaaggggagaagagacaagagatgtctaaaataaacagtaggaaggaggtgagaaaaattctagttactgagaacacaactaggaatagctcagaaattcagaatgcatgatagcttagacatttccatggtaacactcatggtacatggggtgacacctaatgaggttcagtttatcatgtcttcctataactggaaaagaataatggaaacatgaaaacacaaacaaatgagtgactatgaaaatgagtccaagaaacacaagacacggattggtagctatcaagacaaacaatatccagataacgtcttgatcttatatcagcatcctgttataggttagcaaactctgagcaagcaacactattttctcagtcaatttctcttactagcaggctgaaacttgtggttacaaagaatgtataaattattttaccatttatctttaaaagtaatcttataaaaactttaaagaattataaatctgaacacatataaaaagtcatttctactttaattattcagcttgcacatataatcaacattgttttattaaatcataaaaagaagccgagggcaaaaatcaccctaagaaatcaattatcagagaactgaaggagctgaaggggtttgcaaccccatagagagaacatcaatatcaaccaaccagaccccctaaagagcacccagggactaaaccaccacccaaacagtacaaatgtagcacaggatagccttgtaggtcatcaatgagcggagaagcccttggtcctgtgaaggctgaatgagccagtgtaggggaatgccaggactggcaggcaggagtggattggtaggtagggaaacaccctcatagaaacagagtgagagggaatgggatagggggtttccagggtataggaaactgggaaagtagataacatttgaaatgtaaataaagaaaatatccaaaaattaaaagatattaatcaagagctgggctttagaaaaagaggcaggatagctagtgttgttctgactgccattgttcctatttcttgacctcaaaaaatcactagtcaataattaagactgtgtttttctgaacttcaatttggtctataaatttaatatatcaacaccactaacaaaagaacaaacttcgtagtgtaacttcattaaaaatctagttttcaaagtactttccaagcatggagggcattgctaaaaatgtacgtatcttagctttttccatgagtggaaactaaatcattaatctgttcaaagagaaagatcaggcagacaagggccagtgatactgtaccgtaaggggctggtagttcactttacattttcatacaatcttttttgtcattttttttttggtaactggtcaagatatgaatacatatatatggtttactaaagctttaatcaataattagtcaataattttattgatataaaaagcactctaatatgcacagatttgtgtttttaaaacaattttattttaatacagtttaattaaattataattatatcatcattgtatcattttaacatttcttttctccctctacataaatgaattgggccctcttcactcttaaattgatatcttcttaaaaacatatacatcatacatatgtttcataatattggctcatacaattgtcaaaatccatttttattaattctccagtttctaatatcttatcatcattcttttgtaaataatttttcttactgattttatcaatacttaatgcatctatattattgaaccctgatgttctgtctattgttttactctcttttaatctccctatgccacgtgctgtgaatgaatagacaaagcatcttaaacatggaagatggtattcctcaaacttgatgatcagaaattccctcacaggaaaccagagccacaaagttatgatacaatgggaaatttgctgaggccctataacatacaaagtctatatagaaccagtgtcatggagcacagtgacagtagcatacctgttaggaagaaaagcctgaccagataaggggatttctcaaatgggtcaggtgttattctgagaatagctctagtgttcctgtgatggtatattcagtctgaagatctaaaaacactcctcaagggcagaatctgacaaaaaaattcttacaaattatatcaacactattgtgactaaactgctggttttctatatctttatttaatgcaaagaatgctatatttggaggctcatgcatatccatcgatttaaaaaaatacaaacactaaaagagaaaggaaggaggatgttagaaagaaatgaaaataagaaggaaagaatggaaaggaatgaaaggaaggtataagggaccacatttgagaagaagagtggactattgggaaataaggaaggggattgtaagtaactgaaaaatgatgcatggcatgaatgagatcactggaaatttgaactttatgatttgttcaaaaagtatacaactgaaaatttaataaaactaaactaaattcatttcattcaccattctagtttagaatgtgtagttgtgaaaaaaatcattgaccaatacgaacatgaagaaaagatggttatatcatctaaaagtcctagggtacagattatcactgaagaatgtcatggctgaaaactgcagagaatcactgaagtgatgaatatggcgctaaactacttactaacttgctcgctatggcttactaaactatcgtttatttattagaggatcacaggccaaaatgaaggcactatttagagaggcaagcagaaatgtttcagggcaatatatttatggtgtcatgactggaatagcataatttctcagtgtatcacttgtactgtgcagggatcctgcttcactagcaagtaatccatttaacagtcattctatggtgaggtatacaaaaacagagtaaaataacaacttgagagataaattttttgcctgagttcactgtttagccatcactctaggttctataatatccaaatctaaacaaaatacataatcaattacctgcctcaataataagaattttattttatataatataatgactataatgtgtaaaatcatgtatatgttagcattcatatcagcaacctaagatctaaattaaactagagattttctagggctaatgtacaaacaaaatatcattaataatttttgctgaaaattgtgtcatggtgctgcctctgccctggaccacccactgccagaccctacttgcctttggggttggaggtgaggtgaaagagaatcaaggcacatattccagaagcagttaagaaacaactcagcaagctcattctaaccttactgcaagctctatcaataccttcgacccatttcccattggtcccaagaaagcgtccctcctaaacagcagttcctgattggctgtcaatggctgttgcagcaaaccttgttctctcaggcagttttaagttagatcctcctgcaggagatgcctttgtggttgtgtgaccaccataatctatgcagatgtggttgcactgtcccatatacatttccattcttttgtttttactttttgacagtatagtggaagctggggtaatattgccttaacattgttaactccacttcagaggattccaagcataatggattgtgtctgtcttagtttgtgtgtcttccagaatcttatgcattattgaccaccagcctcaaagagatatcactctggaggcaagggggagatgagaaacggcctacatactagtctcatggatgtctgccatccaagctttagtcatttcattaggaggttgcaatctgaatttttgagagctttctgcacattgagggtcacgttatttgtggtgcactgcctggagatattttgggtgagacacttaaacaaaattatttttggtgtgacaactcccccctcatagtgcaagtaactatcaacgaggggtcaaaaagcctcttaatattgtcccacactgctcccaacattcctacatctagagagagcacagataccctggttatattgtggttatctatgttctacattaatagcacagatagttaaggtatttgtctgacaaggtaccttcaagatattgaggcaaatgttgtcaggcctcagtggtgttatatacctgattaagggataaggcagattggtgaaatctggggaataaagtcctatcccaaccaagggccaatgattctactagtatgtcaatcagttgttggaaaatgtagatgtcttgttaaagatgttcatttagtacctcctgtccctgtagtacctcagctaacttagagaaaaaaacattaacagtctcagctgtggtggctgtctgggtcaaggcaagaatagctgttattaccctggcaatgccttcagttaaagccacagtggtggcagctgtaaaactaaaatccccctttttcctggtataggggttgtgagtctgggccatctgggccagtgagtgtcagcttgaaagttggtgatatttaccaaaggcatccaaatgctattccccatcagaatagccattgttgaatactgttcaggagattatcaggagacatttttcattaaaacagttaaggctatctctgacaatggaggtattggtggctagaaagaagaagggacatcagacacagactggagtggctttccaaccaacctggatgccaatggtcacattcatgcagtcaccccagtgcacaatttctccaacaggttcatatggaaatacaccacactaaagaggcagtcaccatttagaagagtaagggggcataagtcaagacaattagaggggccacataaatccctattgatcataatgtggtcataacagcatctaatgtgatctctattaacacagaaagtaatattggaagcatcatgtgagttaaactttgacatgccaagtgtaaggttagaagacaatattgggtattccctagctaattttatgcctagtgcagtctggcagtgctctcaagggatagaaagttcgaaaaaagtggtcatttgaggggtcctagaacagtgaggcagaggtggatgtgatatttttcaggatttttaatcagtaagggaatgtgaagttccatgcctgacatgggttatattactgtgaacgtcccacatgaccatattgtgtagttgaatacaaggaccaatggatgagacattggtggtaaagcagagaatttcctcagagtgccaggtgccttctaatcactgtgtagtagtgacaagtccaagaaaggcaaagttgttgaaagagaataaacagggtaagttagggagttaacagccataggcaaataatggggtctagggggaacatggccaccaatgcccagagctgatcagtcttcccaggctaaagaaaaaataataataacagcattatgatatatctccgaattcgttcttcttctggcttcttaaatgccccctggtctgtggctagacaaacatatcttgagggtaccatagtgtcacccttgcattctggggggaacagaaacataactttgcccccttgacattaaaagagtgggccgttgtctttgaaaggctattgagtcccttcatctaaccaatgggtgggaagtgctccattgcaaaaacacccaatgtttgtaagcagggcccattcctttctcttcaaaatgcagaaagttcacattgaacatgacctccactaatgatagatgtggatatttttagggtaatgtggaggtgactcgagcaagtgcttccttcaaggattcactctttctaagattgcttggccttgatgattataggctatcccaaagaagtgaatgatcctccataagaataagaaggtgataaatagctgatatgagtaagcagccccattgtcagtcttgagtgcgcaaggcactcccattacaaatattaccaattttatggccttattagcatgagaagtcttttcacctgccatggccactgtgtatatgaaagcagagtaagtatctatcatcacatgtatttacctaaaattaccaaaggctggataatgggtgatatccatttgccagattgcattggtgagtagacctgtatggttaactcttgatctgccaggggcccacaatggtgcaagaggtagacacattccagaggaacttgcaagatatttatagtgttatataagcaattctgaaaagagcttatgtaaattgtgagaggaaagtttaaattgatggtttaaattaatattagggcttgttctagcaattctatgtatacagcccattctgccataacacaggtaagacccctcatgggaatacagaatcatggcctgaagggggttccttggatcatgcctttctagtgttgataaagaaagaagcatcataactttctatagaaggttgctagcttcagatgttagtttaaccctgatagaggggctaataggcccctccaagaaagtaaagacatgcctcatatccttgtccaaaatagataggaaaggttttagccagttaatagttccacataattgttatagttctaaaagggagtaggattttttaccatggtggataaagccaggggcttaatcttgtcagaattagaaaagctcaggaaggcatatggaagcactctctgaatcttttcaggagcaatcttcaagttgaatttttccaagttaagcaacaattgagagaatatctctactgactagttttgtgtaaacttgacacagctggagttatcacagagaaatcagcttcagttgaggaaatgcctccatgagatacaactgtaaggtattttctcagttagtaatcaagggggaaaggccccttgtgagtgggaccatctctggactgagttctatatgagttctataagtcttgagttctataagagagcaggctgagcaagccaggggaagcaagccagtaaagaacatccctccatggcctcagtatcagcccctgattcctgagctgtttgagtttcagtcctggcttcgttggtgataaacagcagtatggaattgtaagctgaataaaccctttcctccccaacttgcttcttggtcatgttgtttgtgcaggaacacaaaccctgactaagacaatactttttcaagatctggtaggctaaggtatgcaagcataatatcatccatgaaatggactgcaaagacatctctggggactcctgtatggctttagtctgacaaattgctggactattttcacacctgtggcagaactgctcactgacatattttatctggttagttcatattaggctctcagctattctgaagaaaaatggcatgtattctgggaaactagagggatttggataatagcaatccttaatatctaagttcatggtacttgggtggaatagcacaagggagaggcaggcccacttgagtgttcatcactttttccatatgttctttaacaactctcagatcctggagaagcctatatttccctcatttcttctgaatgacaaaaaatatttattattattattatacaaagtattatgtatgcttctcaaggattccaaatgactcaaagataattgttccaagactagttccttggaaacaaaaagcctaggttccaaaatgggccactgatccacccagatgtcagcttcacactgccaggccaaaagtataatgtcaggtaccttgatgtcaattggtgttgggtggacagtcatcattatatttgggttgaaatcactgactttgtgacctgtgcagtccagttggtcatgttgcataacatcgtcaaaaaaaaaaaaaccctagtaagtatggcatccctgtgttctagaatatctttttcccaaagtttgtggggaacatcagccacaacaggtgtcaaagattcctgatttctgttcaagtactgcctacagacaggtcaggtagtcattttggtggcttgctagcttacaaattctgtattgaagggaccaggccagaatctccaatgggggaaccttattgcttaatttttacatttatagtgacatctgcccatgtgtcaagtatccctttaacgggtataccatctaaatgtacagtaatcatcagggtgtatagaaatagcaagttccaaaggactactggccaagcagggctcactcttactggcatggctgaggggtgaactttttgaagtttaaattgtcttcctgcttttgggagagcttagccagtgtaaatttaagctttgacaagggtcagtttgctctcatgttcaataccatactaagcataggaaggacagtattttgtgattgtgttacctcactcaggatgatatcctctagttccacgcatttgcctaagaatctcataaatttatttttttcaatagctgagtagtactccattgtgtaaatgtgccacattttctgtatcctttcctctgttgaggaaacatctgggttttttccagcttctggctattataaataaggctgatatgaacatagtggagtatgtgcccttattaaatgttggaacatcttctgggtatatgcccaggagaggttttgctggtcatcattgggaagagaggatcttggtcttacaactattatatgcgccagttctggtaataccaggtccaggaggcaggaatgggtgggttgggaagcggtgggaggagggtatagggcacttttgggatagcatctgaaatgtaaatgaaaaaatatctaataataataaaaagatcatcttttttaaaaagatggtattaataagttctaagccaaaaaacaacaagagaaatattttttatcaagtttaattgattaatgctttgaaggtcacaatattatctggagaaaccaatctgatcacaaaattgttattctttttttttcatttattattaggtatttagctcatttacatttccaatgctataccaaaagtcccccatacccacccacccccaatcccctacccacccactccccctttttggccctggcgttcccctgtactggggcatataaagtttgcgtgtccaatgggcctctctttccagtgatggccgactaggccatcttttgatagatatgtagctagagtcaagagctccggggtactggttagttcataatgttgttccacctatagggttgcagatccctttagctccttggctactttctctagctcctccattgggagccctgtgatccatccattagctgactgtgagcatccacttctgtgtttgctaggccccggcatagtctcacaagagacagctacatctgggtcctttcgataaaatcttgctagtgtatgcaatggtgtcagcgtttggatgctgattatggggtggatccctggatatggaagtctctacatggaccatcctttcatctcagctccaaactttgtctctgtaactccttccatgggtgttttgttcccacttctaaggaggggcataatgtccacacttcagtcttcatttttcttgagtttcgtgtgtttaggaaattgtatcttatatcttgggtatcctaggtttggggctaatatccacttatcagtgagtacatattgtgtgagttcctttgtgaatgtgttactgcactcaggatgatgccctccaggtccatccatttgcctaggaatttcataaattcattctttttaatagctgagtagtactccattgtgtagatgtaccacattttctgtatccattcctctgttgaggggcatctgggttctttctagcttctggctattataaataaggatgctatgaacatagtggagcatgtgtccttcttaccagttggggcatcttctggatatatgcccaggagaggtattgctggatcctccggtagtactatgtccaatttcctgaggaaccgccagactgatttccagagtggttgtaccagcctgcaatcccaccaatggaggagtgttcctctttgtccacatccacgccagcatctgctgtcacctgaatttttgatcttagccattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggtgttatttgattttctgaagtccaccttcttgagttctttatatatgttggatattagtcccctatctgatttaggataggtaacgatcctttcccaatctgttggtggtctttttgtcttattgacggtgtcttttgccttgcagaaactttggagtttcattaggtcccatttgtcaattctcgatcttacagcacaagccattgttgttctgttcaggaatttttcccctgtgcccatatcttcaaggctttttcccactttctcctctataagtttcagtgtctctggttttatgtgaagttccttgatccacttagatttgaccttagtacaaggagataagtatggattgattctcattcttctacatgataacaaccagttgtgccagcaccaattgttgaaaatggtgtctttcttccactggatggttttagctcccttgtgaagatcaagtgaccataggtgtgtgggtccatttctgggtcttcaattctattccattggtctactggtctgtctctataccagtaccatgcagtttttatcacaattgctctgtagtacagctttaggtcaggcatggtgattccaccagaggttcttttatccttgagaagactttttgctatcctaggttttttgttattccagatgaatttgcaaattgctccttctaattcgttgaagaattgagttggaattttgatggggattgcattgaatctgtagattacttttggcaagataaacatttttacaaagttgatccttccaatccatgagcatgggagatctttccatcttctgagatcttctttaatttctttcttcagagatttgaagtttttatcatatagatctttcacttccttaggtagagtcacgccaagatattttatattatttgtgactactgagaaggatgttgtttccctaatttctttctcagcctgtttattctttgtatagagaaaggccattgacttgtttgagtttattttatatccagctacttcaccgaagctgtttatcaggtttaggagttctctggtggaatttttagggccacttatatatactatcatatcatctgcaaaaagtgatattttgacttcttcctttctaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaacacttttatcatgaatgggtgttggatcttgtcaaatgttttttctgcatctaacgagatgatcttgtagtttttgtctttgagtttgtttatataatgcattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgtggggtctttttgtggtttaggtatcagagtaatagtggcttcataaaatgagttgggtagagtaacttctacttctattttgtgaaatagtttgtgcagaactggaattagatcttctttgaaggtctgatagaactctgcactaaacccgtctggtcctgggctttttttggctgggagactattgataactgcttctatttctttaggtgacatgggactgtttacatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatattgttgattttttcaaagaaccaactcctcgtttggttaattctttgaatagttcttcttgtttccacttggttgatttcaaccctgagtttgattatttcctgccatctactcctcttggatgaatttgcttcctttttttctagagcttttagatgtgttgtcaagctgctagtatgtgctctctcccatttcttcttggaggcactcagagctatgagtttccctcttagaaatgatttcattgtgtcccaaaggtttgggtacgttgtggcttcattttcattaaactctaaaaagtctttaatttctttctttattccttccttgaccaaggtatcattgagaagagtgttgttcagttttcatgtgaatgttggctttccattatttatgttgttattgaagatcagtcttaggccatggtggtctgataggatacatgggacaatttcaatagttttgtatctgttgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccagatctgtccattgatgaaagtggtgtgttgaagtctcccactattattgtgtgaggtgcaaagtgtgctttgagctttactaaagtttctttaatgaatgtggctgcccttgcacttggagcgtagatattcagaattgaaagttcctcttggaggattttacctttgatgagtatgaagtgtccctccttgtcttttttaataactttgggttggaagtcgattttatccgatattaaaatggctactccagcttgtttcttcagaccatttgcttggaaaattgttttccagcctttcactctgaggtattgtctgtctttttccctgagatggctttcctgtaagcagcagaatgttgggtcctgtttgtgtagccagtctgttagtctatgtctttttattggggagttgagaccattgatattaagagatattaaggaaaagtagttgttgcttcctgttgtttttgttgttaaagttggcattctgttcttgtggctgtcttcttttagttttgttgagggattatcttcttgtattttctagggcgtggttcccgtccttgtattggtttttttctgttattatcctttgaagggctggattcgtggagagataatgggtgaatttagttttgtcgtggaatactttggtttctccatctatggtaattgagagtttggctgggtatagtagcctgggctggaatttgtgttctcttagtgtctgtataacatctgcccaggctcttctggctttcatagtctctggtgaaaaatctggtgtaattctgataggcttgcctttatatgttacttgacctttttcccttactgcttttagtattctatctttatttagtgtatttgttgttctgattattatgtgtcgggaggaatttcttttctggtccagtctatttggagttctgtaggcttcttgtatgttcatgggcatctctttctttagatttgggaagttttcttcaataatcttgttgaagatgtttgctggtcctttgagttgaaaatcttcattctcatccactcctattatccgtaggttcggtcttctcattgtgtcctggatttcctggatgttttgagttaggatctttttgcattttccattttctttgattgttgtgccgatgttctctatggaatcttctgcacctgagattctctcttccatttcttgtattctgttgctgatgcttgcatctatggttccagatttctttcctagtgtttctatctccactgttgcctcactttgggttttctttattgtgtctacttcactttttaggtcttggatggttttattcaattccatcacctgtttggttgtgttttcctgcaattctttaagggatttttgtgtttcctctttaatgtcttctacctgtttggttatgttttcctgtaattctttaagggatttttgtgtttcctctttaatgtcttctacttgtttagcagtgttctcctgtatttctttaagtgagttatttaagtccttcttgatgtcctctaccatcatcatgagatatgcttttaaatccaggtctagcttttcaggtgtgttggggtgccctggactgggcgaagtgggagtgctgggttctgatgatggtgagtagtcctggtttctgttagtaagattcttacgtttacctttcgccatctggtaatctctggagttagttgttatagttgtctctgtttagagattgttcctctggtgattttgttacactatatcagcagaccagggagactagctctcttccctgagtttcagtggtcagagcagtctctgcaggcaagctctcctctttcagggaggtgcacagttatctggtgtttggacctcctcctggccaaagatgaaggcccaaaacaggatttttcccagaagctgtgttgctttggcctgcagactgcccgctgcggagtcccagaatcaaggtggcccccgcggaacgtgaggcataagccttacaggctgtgcggacacctgtgctctgaccaggaaggtggcaggttgtctggagccgaaaatggcgccgcctcagaggctctgtggctctagcccgttccagaagctgctggcctctgtgttccacactctcacccgcagaccgccggccgcggggtctccgaaccaaggtgacccccgaggaacgtgaggcagaagcctccagggctgtgcggacacctgtgctctcaccaggaaggtggccggttgtctggaggcggaaatggcgccgcctcagaggctctaaaattgttattctttaggaatggacggtggccaataaatgtatttctgttaagtcaaaaaccaatggagtaggcacaatcaattctaaatgacaaggactacttttcagaggtggaagttggtcactttgctgaataaggcaaatggtaactccaggttagaatatgattttttcaatgcaatggtctattatattgacaggatgtagaacagtgtgatcatccacaggatgaaaaagatacgcatgacaaccttctctcctcacatattcagctgcatagatacaaatacaggttcaccagagtagaatgcaagttgatcaatattttctgagtctatgcacttatttcatctttcctcctgctttgtcaatttgagtatatcttcatcatcacgcagactacatactttattcatcccagcaaaattaatatcaaacaaatctttccatgttcttgagcactaaagctgctattgtgagaaagcacttgtccatctttctctttgacctggtggatcaggctgagactcagaaatgttgggcattttccccacacactaccaacacccaagcatgaagcagaggaattgtttctcatccatctcaattttaccctagcacaaatgctttacttttttttctgatgggtttattatatggaccttgatataaccattctcatgtatacacatgcatatcatatcacctctctgttcacacaaacacactcagtgattattttactccccacaactattctttctgctttgacattgactgctcctgaatttttatttgaactgtttaatcctatgctttccccttgaacatggggattatctgtgtcaataaagggtagcaagaaagaggagatgtaactgccctttttccatttttgaaaatccattccatgaaaaaaatctgcgtgataaattggcctcattctgtaaccttaagcttataaatgcttacatcaatatggtgtgttgacaatacctttgctatttctaggatcatagacatttatcactatgagcatccactgctgccatctgacttatacctgtgcaaaatctgtgtattatgacagtctctgtgaattcaaatgtggatcagtttttgttgtattttgaagtatttgcttcccaggtgttttctattctcattggatattatttcttttctatctccttttctacaaaattccctgatgactcaaggcaggtattaaatggaggtattgtattaaggattgagtggtccaagttttctaactctctgtacactgtccagatgtgagtccatgtattcatcctcatctacaacaggagttagcttctctgaaaatagccaagcaactctttcatcaatgtatatagaagaatgtcactaggagtcattttatagttgtttccttggtatagtaataacatttgatttttccatagatttattatatctaaaatccatatatccacagttaacaatattggaaattattgatgacatgagagaaaacttattcacagagttggatatgagtaaaaattctcattagtagcatatacactagcattcagtgcttcacctggagtgaaaaaaatattaccagtcttttagtattgctgtgaagacttacatcctaaaagatcttgtaaatctcaagccacattcagcatacatcttgttttatgagtgtatttttcagttaattatttaacattgagaaacattctaaagcctaaacgtatcctcccatttctgtaaaaagaactactgtataaatgtacagatctcacaattaaatggtgttactgataaagtgtttttctttttgtgatcttgaggtatgaactccctcttctgcccaagaacttaggacgtgctcctcgcctatttaataagaagattacagagacacacagaagaataactagacagtaataatttagaaaaaggtgcttgcttcctttcttggttgcttgcttactttcagctttccttattaatttcttttgtgtttgttatattcactttttattgtttcatttcattgcatattcattggctatatttttaaatctagatattttgtgaatatcttttctttcaggagaaatgcaatatttcttaaactagatgttattaatctttcttgccacagaggaaaactatatatttcattttcctaatgtattgtcctgaggacaatatctagtaagtgttcaaagatctgaaatcagcttgtgtccctttaattctaaccttaaaaaagtaccaagaatgtcaggtattttcttccatagatattaatgaaatccctcttacgtacataacataatttgctgtgtgtttcccccatggctgcatgtttttaataaaaatgatagtttcatataattatataggtatctgtaaagtaactttcaccacattctacatcattactactcttttttctacttaaaccatatattctaaatcctcttactactttattttctttttgaatgaatttttgacaattttttaaaaattattctacaataatactaaatttacctaatttctatacttcaattctgtatattctgcactcctctttaaaagtcattaactcctctttaaaaattattgttacatgtgaacacacataaaacatgtatacatttgattatggacacaaatatacagtgggtggaacctaggatatagaactaataaactaggcatgtgaatgttccagactgcagcagtttatactctgagggttaacaagtgttacaggagtaagtgctcatgaattcaagctgtatacaacacaaggataagctacatgtggcaaaaacatgttttaaaaaggcatgtgggtagtttaaacgtttaattaaatactgacagcaaggaaaaaaaaagagaaatctcagtaaatacactactctgcactacacctatgacgagcatgaaaacatattctacagttctgtcttctgaagaaatgtaattcgcaaaactcatgatttgttttttattgtaatattctgttctatttttctttatcctggcctattctcatgagcattaagaattctgctaaatctctccatttcttgatcctcttccccacctttttaaacattgaaaaaatgattaatttttaggaaatatgcataaatacaccatgaaattagattcttatcatttactcactgtgatgccgtacaaaatattgtgtaaaagctacgtttaatccgtatttcataaaggaaactattccaggcagtcaagtgactaagtaaggtaagacagtgacaaggacatagctagtttgttctaccatttaactcaagcacaacctgggaatcagcacaagttcagggagagccttaaaatatgataaaaactttgatttttttcttgatttctttcttttttatttattctctttgcactcccattactgcttctcttccataatcactcctccaggccccctccctttctcttttaagagggtggagtccttcacttggtatccacccacctcagcacatcaagtctgtgccagtctagaggcacatctactctgccttaggccagacaagataacccagatagtagaacatatcccccacaggaaacagcttttgggatagccacaagtccagttgttcaggacccacatgacaacctatttgcacatctgctacatattatcagaggggaggggaaatgctaggtccagcccatgtatgttctttggttgttggttcagtctctgagagctacagtgttcatgttagatgatgccactatctggttaattaaaactttccattaacatttacttgtttttaagtagacttctcttgtagatacctcaaaacacctccaaatcctgtaatactatattgcactagccttatgcttgacagtttttttatttttatatgatttaacaagggcttatacttaggtcttcatgtgaaaaatggccaatatatgaactgagccatacctatagctcatttgacttttttttacattttaataatatatgtataaagtcataattttctgtccttatcagctgtttgactagtttcattatcaaaccatcatgtaaaattgtggggaaaataatttaaaatgcatgtttatcatagtttgcattaattattcaaatatttcacttattaaccagggaattaatcctgaatgctcatgagtagcacctaaagagcaaccacatgaacttggaaggggacactttctgctgattcctgagttctgatttcaccctcagacctgatctacatctgcttgtttgactagaagactgtaagtaaaggcataacacagatagcatgatgtattcattggtttgatgttgacaacaatccataaaaataataacactagaaaaaatataaaaataaatggataattattttattagtattttgaggagagtactcactgcaatttgcacaaccacatgcactatattattcagggttctctataggaaacttgacctttcatattgcagcctgagaaattttttacattgtgtcaatagcaaaggaacatataattactcctatatagttcaagttttctcttcctttcattttatcatgttttgtattattcaaagtttataccaaaggtgtgtatatatatatatatatatatatatatatatatatatatatatatatatagtgttcatgttagatgatgccactagctggttaataaaaaactttccattggcttttacttgtttttaagtagatttctcttgtacatacctcaaaacacctccaaatcctgtaatactatattgcacacacacacacacacacacacacacacacaaacacacatatatcttgtatatcatgataacaacctcaacaccccaacctagcatttttattttttaatgttgaattaatcatgttgtctcacatatgctaagccaccactctttaatgagtgtatatgtgcaaccacttcctaatctgtcctagagtcacggtccatattacttttcctcaaaagtcaagctaacctttatatgtttgtatgctttaaactccctgtgtttaattattgctttctatatgtacattggttttgggtcatttatttttacattagcatcctactgcagttgcatacatccccatgtacatctggttttccctcccttgtacctacccactgtaaatattttcacatgtagcaggaactccatgtaccctcctcttcattgcttgaatgtttccttacttgattttaatcacctccggtttggtaactaatttttctgttttgtttaatagccatgtcaaaaaatcaatattttctacatctctttgacattttcctgttcatctattcttcccatgtttatgttcatactttttctccctctcttctgcaagctgatataaatattccagaaatgttaaagtgaagaaaatctgtgtgtgtgtgtgtgtgtgtgtgtgtgtgtgtgtatgtatatgtatatatatattatatatatatatatatatatatatattcatccatatgacattattgcatgggggaatctaagtccttaatttgtttttaggaaaaaataagactcagcactgatatctccacaagaataatacaggacatttgagaactgattgttttttcaaaatatctaatccaaaggtcaattatcagaatgctagactttagactatttcatctctaactactactaaaaaatcttgttaatatggctttattcaaaactcaaactttattcactctaaaagaataaactaaacaatattccagataacagcatcctctaagatacatttcttcctttttttgtaaactgtcatccaggattttatgcctgtttgacaattgtggagaaagttttgatatagtcatcattatcatgtcatttctatacccctttatgagtgagaggcgtgatatcactaactagtaaacgtgaaacatcagttaattttataattctagtaatagcaaggagagtagcaggattctgctctaataaagcagtaagcttttaccttgctgtgtgggttgtttttatatataatccacagataaagcatatgcctattaattggagctcaataatccattcgttttctggtgttgttggaagattttccagtaatagaagaatttaaagagggattacatgataggataaacagagaaagagctactgaagtattggaatttaattgtcaaaatatgtcagtttagatttagttcatttaaaaaatgaaattataggaaaaccaatttctgcactaatgaaattgtggaagtctctgaagattttcaagaagttcacaagggcatccacggaaagtcaagtaaatgaaaccaagtctacctgataagggcaattatccatttttcatgatacttttcctcataaacataaactgtctaataggatataccttcctaattaaagttcaatatatcaccatgacttcactacttcaacttttgaacatttgggaattgttcatataatagtcatataaaggagtaatcttcagaagatatgccttatcttgttgggcatctaactggggaagaaagtgataatggtagtcccaatgaccattaggattaagtgttttcttgaactatgtgtagactttgcaaggactctcttcataagtacaataatcactccacacctctggagttattgaactgtataaacctccctagatataagatgaggggtgatgtttaaattacaaacatagtgtaatgaacaggatagcagcagaggccatatacatcatttcagacattagtggaatcaattcagatactgatggagaggataattgaggaaatcaaaatgacataagtggaaagattctgggagattgagtaaagttgatgaacacaaacagtgttagtgtctcatgtgcattctgatatatacaacattaatatatgtgttaaagaccaactatgacactgtagggaaaactgaggaagactgcaagtggcgatggcaggggttggtggtaagagcagctgaagaatgttggtccggatacaaacaggagctgctgcctatggcaagcagtgataagacagggtgtgaggggagaagaacaaatatacacacacaagcaaacacacagaaggttgaaacaagggatgtgcttcaacaatttacttttttccctcaacagttatttagatcgcttaagaaaaggttttcttttcttttttattttttattaggtgttttgctcatttacatttccaatgctatcccaaaagtcccccataacctccccccccccactcccctacccgctcactcccactttttggccctggcattcccctgtactggagcatataaagtttgcatgtccaatgggcctctctttccagtgatggccgactaggccatcttttgatacatatgcagctagagtcaagagctccggggtactggttagttcagaatgttgttccacctatagggttgcagatccctttagctccttgactactttctctagctcctccattgggagccctgtgatccatccaaaagctgactgtgagcatccacttctgtgtttgctaggccccagcatagtctcacaagagtcagctatatctgggtcctttcagcaaaaccttgttagagtatgaaggcaaagatgcagtaattagtggaaaatctgtaacttctgggtatatttgaacttttcactctttgatcttagtatttcagaaagtagaaatagtactgagactagtagaagatgatgtgcactcacacacacacagaaacacacacacacacagagacagagagagagaggagagagagagagagagagagagagagagagagagagagagagagagagagaggagagagagagagagagaaagagaaagaaagagagagagaggagagagagagaggagcaagagagagagagagagaaagagagagacccttaggaataggcagtaattgtataaacttagactaatgattgacagtagtacttatctgcagtccacgtccgtatgtcctgtaacaggtcgaacaactcacaattcacggaatttttttccttatgttgttttatttattacacaacatttacagtaatgcattctattaattaattatatagcctaatcaccattcacctcccggtctgccctccaacccctccccatcttcctttactcccctgtctcaaataggatgtcaccatcccctcaccccaccccacccgaccaaacctcagcataaaactatttttttttataatttagcattactacaattcataacatgtacttaaattctcattgtaaaagtttagttgggtgcgggaaggggggttggagacagggaatggaggggagttataggatattgaggagtcgcagggtggactagaggggaataaaatctggagtgtaaaaaatagataaataaaagaaaaaagtaagctaacaattgtctataaattgctggaattggctaatgacttgagtaataacaaaggtttttgaaccattctttcttctatccaaaaagttggaataggtttaagtttctaaacccagaagatctgagagattgtcctgtcttaaaaaacaaaaacaaaaccaaaaaccaaaaaccaaaaaccaaaaaccaaaaaccaaaacaaaacaaaacaaaacaaaacaaaacaaaacaaaacaaagcaaaacaaaacactgagagactggaccaccattgtgaggcaaacaggatgtaaaggaaaaggacaattttgtctaatagttaccagtaccacaataccggtggcatcctctttggaaatgttcatagaactgctgcaaggaactggaattgttgacaattaaagagtcttatttttggatgttttattttggcttttttttttcattagacactttactgtaatacttaacagatctctggtatttccaaagagttttgagggccaccaattaagtatacctcatttcaaacaaactttgcttgttttagttttttggttgagattaaatcttgaaagcatctacagaagttgaaataaagcttttcccaattagtaaattacttatgtaactgttataactgaaagcatagttctaagaacactaacaaatttagtcttttataaggtacctgaccaataagtgtcttgacttaattctatttaccagtttattctttggactttaaaaaattagaattttacagctttcacattattaagttttaaacttaaattatgatttggagattgaaaatcaaaaataaaatattaaaccctaagtagggtccacacggtgtgtagaatatttattttattgatttttttatagtacacatttacaggttatcacagatttttttgtataaatcagtttcttcaaatagctgtaacttaaacaaagttagcaaaggcaacgtgttacacatacatcttgaagtcagtttgcactagcctgactagaacttataacaatttatcaaacatgtccatttatccaacttatgatattccttctctaaaattttacaagtttctcttccaccaagtcgtttcctttcatctgcacctaacaatgttttattttccttttataaatgatattcaaagatattctcttgttcttaccctctccttcagctctttttgtgtttgtggaatatggaatgggtatcctataatttctggctaagatccacttctcagtgagtatacactatgcatattcttttgcatccaggtgacctctgttagtatgaaattttcaagttccatctatctgcctgaaaaattcatgatgtctttttttaaatagcttagagtattctattatgtaaattaaccgtattttgcgtaactattcttcaggtgaggggactctggtttgtttctagtttgtggaaattatgaatgaaagaactattagtatattggagcaagtattattgtgctacagtgcagcatcttttgtgtatatgctcagggggattatagttagatcgtctggtagaactatatccatttcttttaaagaaaccaccagattgttatccacagtggttgtagatatgagtaatcaaccaaggacatcaagctctctccttcaaggaaatatgaaggaaatttaaaaaaaaggagtcagataaacataaaatcctgtagcattacagacaggacaccatcagtacttagccaatttaaattaaataataatttctactggacaatacacaggctgtattcaggaaacatgttaaaaaatacttgaaagctgtggaattgtgcctcttgtatataaatactatccagatattcaccattttttgatggtgttacaccaatagcaaaattcaatatttattgactgaatagatggacatgttgtttttaggtaagtcatgcctctgtaaatgtaacactgctattttacatattcttgatgatagtcacttctggcatgatttgaaaatacatcactccattttctgagatgtctttctacgggctatgatttctctgtttctttcttaatggctgttcttttttcttttttctttcttttttttttttgtcattgtgttactatgtttattagtgattagaaatgggataacatggggaaaattgtggctcaaggaatattatgaatataccagttgcaatgtcttgtctttctagggtcatttcagcatagtagatgcaggaatctatcacctgcatgatagttttcatccaccaatctgctagccaccggaaaatatttctctaacaagctgtctccttttatttatgaataactttacctgttggtatatatatcatttttttctttgtgttcttctaagcatcagggcttgatcaaatttgaatgacaagcaaattaaaggatagtctcatgtatgtaaagtgagtttgagtggactctggcagctcagatggaaagtactgcgtcttttgggaacttttgtaaatttccttaactcaactggaccaaggaaccagattattgtataaagctatttattgtatataacaagaaggcaggattatggtatataaaagggtatgcatgctcatatactctaagaatatctctgtattgcagcatatcccaactgcatacatctaatgagatgaaacctgtggccaattgtttctatgcacactgtcaacatccccatggatgttgcaataccacctagccttacatgggaaaagaattataaatacagtggatcagtttaatggattattttacattgccatggccagaaacaacaagaatcatacttgtataatttaataatctcacacagaatttctatttacttcttgttgtttttgtggtaagataaacatgagtgctcatacatacatatattaacatggcttttaagggtataagaccctaacagctgtcatcctatactcaatttattaattctataattttttaaatttctgatttaaatgcagtatattattttggatacaccaactgtgaattaaaacataaacaaactcttaattctaccactttgagaggctaacagtcttcagtgagccaccagccctcaacagaactgaattactgatgggaatatcattcaggtcataaaactcaacaagtatacagcaccacctgttaaaaaaaaagaacatgtaatctttcaaagtgtttcaaagctctggaaaaggctctaaatatattaactgtgttttgtttgtttggtttggtttgtactgttttgttttattttgttttgtttttgtttttctgcatatttagttctggctgctcctgataaatatatcaaccgagctacaggtgatgtgttgaaaaatctcatcctgggaaaagatacagagcacagaatgtagttactggctcattaataaaaatgtttccattgccttaatcttgtgtttcagtagacttctcttgtagacacctcactacacctccgaatcctataaaactatatttcgctagccctatgcttgacagatttttatatttatatgatttaaccagggattgtacctaggtcttcgtgtgcagagtggctaatatatgaactgagccctccctatagcctcattttatttttcttacattttttaatatatgtattaagtcataaatttctgttcttatcagttgtttgactagttttgttatcaaagccatctaaaattgtctggaaaataatttaacatgcatggttattataatagtctgcattaattattaaaatattttccagttttgttgagtataactttttgtagaaggatctgattgtgttttgggttttctcaggatctgttgtcatgtctcccatttcctttctgattttgttaattaggatgctatccctgtgccctctagtgactctggctagggatttatctatcttgttgattttctcaaagaaccagctgctggtttggttaattctttgagaaaattcaaataaacaaaggtaaaatgatattaaaggaatggagtaacaataagggggcctggtggctactctagcagttcagacaggactgtgtgcaccagggacattgggacacaggtgaagctttagtgatttggggatttctgatttctgatataaactgtgaattaggtgaagtttggggataagttagtgatcttgataagcatatgaaattatttcttaagttattaaatttttttttagttcttagctgcctgaactacctgtatttcatggagagagcatcagtgccgtggctgttatgagtagttacctgttgtacatgtttttaaaaaagtaactttaatctcttttttgattgtttgtttaggttttttgttgttgttgttgttgttgctttgttttgtttttgtttttgtttttttacagttcagtcattttcccctttttggttcatcctctgacagttccggatcccatccctactcctgtttctccaagaagataccccatcatatcctggcaggacttgccacctcctggagcctcaatgtttgatgcctcttcactcactgaggccagaccagacagttccctgtctaaaaaggagacaccttagataaaatgccaaacactggggaggggagacttgtagactccacttccagtagaaagataatgcctcaagtggagggatggggttgccattccacagtcaaaaactctgacccagaattgttcctatctaaaagaactgcaggggcaaacatggaaaaaagactgagagaaaggaggtccagtgaccagcataatttgggatacatctcaaggggctccaagacctgacactattactaatgctgttgtgttgcttacagataggagcagtcctctgagaggcacaacaagcagctgaccaagacagaagcagaaactttcactcatccaatggagagaagcttgttaaccctgtggttgaattagtgaaaggctggagaatttgtggaggaaggtgatttcactgaaaaacttgtaatctcaactaacctggacacctgcaatctctcagattctgaaccaccatccaagcagcatgcactagcaggtatgaggcccctgacacataaacagcagggaccataaccttatatctggtgttctgtgtcatagagaaaaaaattcatgtgctcatatctaaaggtaagaatattacttaatgagcaatatatccagcctacatattttgatattataccaaaaaataccaagtgtatataatccaacatccatacttataaacaatttgtagagccctacaatttctcacaactccagctataaagctctcctaagagttgcttcttaaatttaaatattatttttctgaatactggatttaaattttgaaaaatgggaaaaaaatctgtgatgtttttctgtaagttctacacatatagtggaacaagataaacacaaggagcacatattcaggatcacacacataaagcaagcttctgccaaagattccacatagacatacagtaattctactttccagagcgtgacaaatgtctgttaaggagaagtgatttgtatgaacaggttcctttatgcgcaggtttatctgcatcattacattgtgtttttcatacatattactcatgaattacaatattttgaaagtaggtatttcatatcataaatattgtacaccttactacctacaaataaagcctgttaagagtagtgattatatcacttaccctctccattatcttccattactttctaatccatgtaactgtaaaacagccacactctcatgtctcttacttcctttccttcatctttgtatttttcttcaccaatatagattaatatagtaaatatatatatatagtgagtatattaatataataatatatagtaatatataatatagtatacataaataatactatgtagtactataaagtaacaaatacttaatatagtaatacagtaaaataatacctccatttcactctattttttacctaaactatccagcgaataagaggttaatgtagagaaaattggctgcacattattactgcaatatttcttgaaacaaataagtaatactgaacagccatcttggccatgtgtgtattgcctactatatcacagtgggcacatactctgcatgaacttgccaatctctaacctgctaatgttacttctggatattgaaattttctctaaagcacccacagttttcagggcagttcttaattcaaaaggcaggctgcaatttttcaagcaggaataccaggccaaactctgtaaaagaaaacagcctgcagggtaaattccctcataatcccttaggactcctatatcctgtagatagaggactcagcccagccttagttgcattgttcactacctactgtatagaatatgccactagtgatataacaagaaagctcaataagcaattccacatggagaatagattcacattgtgctttttctcattcaaaatgtctgacatagaatacatgaaatttactgggagtgtgggattatcataaaaactctgcatcacagtgaaaaggtcagcataggaactttggaaatgtcatgaaacactcacccctctggaagggagaggctaattagcatttctgagaccacagggtgggaacagacctgccagtggggacacaatccacaggctgacccttgctcactttcagacaagggaagtccttgtcacctcattccttaagaccaaccagtttaaaaagtgcactattctgcacggtgtgcctagttgctgatgctctgttctgtccctggaaaccatataaaaaacttgctgaaagggtgctgggggttgatgcctttccttcaggtctgggatgaccccagtgcactggaacaataaattcctcttgctttttgcattaatcctggctccaagtggttcactagggagttcccagtgagctaaggctccctggagtcttacaacagtccgcacatattgggtactttcccttacctgaaacatctcctgatatgggatagtgtttgttcatatttcagtaggattcagtaatgttcaaggccaaggaagcttggaaaaatattggggctccatgaaccctgttttatattacataaaccatgtataattactggtttggggaaaccactttcaggggaactgcctgcaatttgagcagatacctctaagtctcctttatggcagatttcataagttgtaactcattttacaatgggttgtttgatgttgacatctattaaatcgtgcattcatgagtaatagcaacaaaagcattggtgcaaaaagacagacactgagtaattcagattctttcagaataagtctctctctttgtcagatagtcacttaatcctgtaaagtgcaaacctaatgggaatgtaaaaaatatatttcacccatgttattatcagtataaatttcttctataccactgcctattgacctgcagtcttaggattcttattggctcaattaaacaccatgacgaaaaacaacttggaaagaaaatcatgtattccattattcagttcatatttaatcctactgataagtgaagggaggaacttgaaagcagaaactgatgcagagaacagtggtggatgttgcctactgactcattcctcatagcctgaccatcgtgatttcttgaaccatccagtgtcacttgttatggagtggtgatgatcacagtaagtaggacacttccacattaaccataatcaaaatactctacagatttgtttacaggccaatgctatggatacactaaggctcttttccagacataccattaagctgacaaaaagcaaaaaagcacacctctcatttctattcttagtaaatttcattcttatatatataccaatcaaagtatctttatttaatatgtaatacctagagtctaggattttcatcacagtgcaattttgaaataaagttgatgcagagaaaatactgtgagttgtatccattttagtatttttaagatttatcctgaggcagttgatgatctatatctttatttaagacattgctgttgatacttaagttatggcaagtgttgtatttcttatatattaacctaacatatgtcctgttttttttttaagatttttcttattgtgttatatgacatacctcatctttaccttacatatttctttcatctttgggagtttagtatttctctagaaatacctgatagtatagaaatctgtgagtctaagaaagtggcaccaataaacacaaaggacctatttgtaatgcctctctgggtcttcatggcaaatgctgtttgctgtgccttacagtccctctggaaaaaaaagaacaacatagaatttagttgtgtttatatgaaaattgactgactaaataagcacactttttgtatgtcaaaagtatatgtgaaatataatgttttgagagggtacctttggtgagtccaggaatgtgcacccctgagaaattaggccttgcagcatatctggtatgaaagggatttattggggaggattgaggagtaagaatatgagcaagggatagatgcagagaagtgcacatgtagataagcagataaaaaggagcagttcagggagggcagataaaaaggggagtagagaaagatcatatgccaggaacagagagagaaacaggagaatatagagagatctaggatggtggggggcccttttgctacacatacctagcacagctggcacacctggcactcctggcacacctagtaggtgctcaggaagctaatgatgtaggcgtctgctatgtccctgagaacaaggcagggaaataggctctatgctaactatatgagcataccaagcctgtgcttccattagttgagtcttttcatatgaatttcaataaatgtgatttttttattttaagtgaatttattttagtattctctttcaaatgaataattcatgattttaccaagtattttaacttcaggtttatatatatatgtatgtatatatatatatatatgtcaattgatttggacattataggttatttaaaatgttattaactacaccgttttaaaaacatttctgcaactccacttataatatctctgcctaaatatgaggagaaaggaggttttagtgaacataaggaaacattttgcttaatatgcaagtaatgtttatggattctttcatttcatagttttctattgtgaaacattttgaaaaatatgttcaaagctgaaatgcaaattacctgcagtctgtttctgtactcatacacttgtcacatttacatttctctttttcctaaatgctacaggcattgtctggagaattttgatgcttttcatagcactagttccatttatatattttcttgtgtatgtgttcttactttaaaattttggtctcttacataattgtatattttacaaagttgttttaaataacagccacattacttacatccatcttggctgatgtcacattaggataaaaaaggtcctatgcttggcatcccactttactaaggttaaagcatccatgccatatctttcaccaccgctatgaagatgatcatatggtacaagccaacttaggcaacactgtaaatcttagagtctgcagaagtggcaagagattgccagaagaccaccagtactttttttggtgcatttctttttactaagtgacaacaaattatgatcaatgaagtatttaggagaaccaatgccaaagtgttgtcaatgagaaccaacatatgaaaagctcaataaagatgagcaaagagtggcaaggtgaaccactgatacaccataattcactgtctattattttatacttatacgctttccaaatctcacatgtactctcaagtgtctagcaaaacatcaaatgctctttattcaggcagtgtccagaaaagctactaaatactttttacaattatatcttctttttttattatatattttctttatttacatttcaagtgttatcccctttcctagtttcccctctaaaactcccaatccactgccccccttccactgctcaccaacctacccattcctatttcctggccccggcattcccctatactggggcagataaccttcactggaccaagagactctctttctgttgataacctattaggctatcctctgctatatatgcaactagagtcatgagtcccaccacatgtttcccttgattggtggtttagtcccagggagctctggaggtacttgttagttcataatgtagttcctcctggggggggggactgcaaaccccttcagcgatttgggtacttttctagctccttcattgaggaccctgtgctccatccaatggttgtctgtgagcatccacttctgaatttgtcaggcactggcagagcctatcaggagacagccatttctggctcctgtcagcaagcacttgttggcatccacaatagtgcctggatttggtggttgtttatgggatagatccccaggtggggcagtttctggatgttcattccttcagtctctgatttgaactttgcctctgtaactccttccatgggtattttgttcccccttctaagaaggatcaaatatccagtttggtattccttcttcttgagttacatttgtttttcaaatagtatcttcttttttatataatataaaaatgagaagattagacaggtcttcttagcttaaaggaatctgtctcaaagatatatgttcaatgatttgcctatggttatcatcaagcttctacagattttttaaagattttattttattttaatgtatatattacactccatattcaattccctgacccatccaccctctcaccgttccacatctcacacctccttcccttccctcctcacctggtcgccacatggatgaccccaccctgaccccacctgacctctaaacactgtggggcctcgagtcactttagggttagggacatcatttctgaatgaacatagaccaggaagtcctctactgtattgtgttcggggcatcatatcagctggtatatggtgctgtttggtgggccagtgtttgagagatcggggaggtccagattaattgagactgctggtcctctacaggatcatccttctcctcagcttctttcagctttccccaattcaacaataggggtcagctgcttctgtccattggtagggagcaaatatctgcatctgactctttcaggtgcttgttggatctttcatagggcagtcttgttaggtccctttttgttagatttccatagtcttaataaaagtgtcaggccttgggacctctgctcgacttggatcccactttagccctgttgatggacattcttttctcggggtgctctccatttccattactgtaattctttcagacagaaacaattatgggtcagaggtgtgactgtgggatggcaacactatccctcacttcatgttctcctatctttctgctggatgtggtctctatacgttccctctccctactgtagggcatttcatctaaagtccttccctttgagtcctgggagtctctcaccttgcaggtctctagtccatttggagggatccccccaacctcctatttcctgaggttgcctgtttacattctttctgcttggccctcagggcttcagttcttttccctcacccaataccagatcatttttacctcaccacccctcccccactccttccatccagtacactttccctcccagtacactttccttccctccctctctacttgtgattgctttcttctctctccagtgggactgaggcatcctgtcttgggcacttcagcttgttgagatgagttctgtgtatcttgggtattctgtactgttttgtttgttacattttttgctaatatccacttattaaataaataccaaaatcttttatagatgtctttgatatatatggtctacaaattcctaagtatattcaatctagcttaaactaactttaatatatatatatatatatatatatatatcaaaccttattgtatttattactaaatttgtgattaaaagtttcttttgatgtaaaggtatcaatgttttattttttttaatttaattttgttttttgtctgcctccaagtcgcccattcccacattgcttcttcccctcctcctccttctcctctgtgcaggtaaggtcctcaactggggtatctcctgcaaccatggcacttcaaatctctgcaaggataggttcttcttctcccatagagtcccggcaagaaatcccagctagtaatacataactcacatacaaagaactgcttttgggataaaccctgttccagttgtccaggacccacatgaatgctaagctacatacatatctgctacatagaagcagggaggcctagatccagcccatgtgtgtactttggttagtggttcagcctctgagagccccagttgatttgacttagtctactgtggagtctctattcatttcagaggccacaatcattccttctattcttccaaaagagcccgcaagctccattcactccttggctgtgggtttctatatttgtctgattcagctactggggagaggtctcagaaaacaacatgatcccgactgcaagcctaacagagtatcattagtagtgttagggattggtgcttacccatggctttggtctcaagttgggctagttgttgtttggcaatccccttagtttcttctccatcccctgtccttacatttcttgtaaagaggataaattttgggttgaaagttctgtgggtcctttggtgtctctattacttcaatgaggttcctgcctggctacaggaggtggcatcttcaggttccatatcctcaaagttattagtcacatgtaaggtgacctgcaatgattcctgggcacttctattatcccaggtctctagcttgtcctctagatgccaccccacccccctacatctccttacttccatcagttgcagatttcctttcattgtcatggccacctcgtcatcttactgtccttctgcttttcctattgatatatatatatatatatatatatatatatatatatatatatatatatatatatatatacatttacttaattttgactctgtagaagactgaaagatgtaccaaactatgagcattacactattataaattgatcaaatactatgaacagagcaataatcatagatactttcaagggtattgtgtttgtctacccacaggtttctggctgtaatagcaataagagttaagtgttaagtgtagaaaactattgagtacatccatgaaattcatgtaacaattttatcatttggcattttttagcagtacagtctctttaatcactgggattcaaagcctagtgtgattgatttctttcctcctctggtggcatagaactgcttccagtgccatgaaagatatccattagggatcaaaattacaggtcaattctatattgatttcccactcttctataacttaagaatgtagtgtgttcagctaaagggcagtttaaccaagaacgttaacaatagcattgcaatgaataggatctccctagaaaacaagccaatacaaagaggtaacacatttctggtattagattttatatttgttagcctgtagtgtccagtaaagaaatggttattctgttatcagttaaccctattgtttaaatattggtatgtgtatatacatattaagaacacttttagagtagtcactttccatatgacttattcaaaatgcctccagtactatttatccttttctatgttccttcttttattctgctcttctattgccctcactgattaatcctcgatgtatcataattttcctttagtcctttataccactcactggttataaagcattctctttctttatatgcatttccatacacctttactagtttcctaatgtatatagttattccaaatacaacacacatatctgaaaaaataatatcagctttacctctgaatcatgttcttctgtgacaaaatttcaataactttaagggaataatagttgaggtgttttgaggtgcacacatatctgtaatttatgtcctcatcttcccaagtacctgagattatagtcctcctgcattaccagggacactgatattctagctttcaaaattgtatgaaatcatcatggaataatgaatggtgggatttttagaaactttaaatttaaggaataacaggaaaaatcatagaacctcttctcttgctaaggcgtgtagccaagagataaacaaacttgtcaagtgtatacgatgtcatagtttaatacctaaaagcaagaactaaaaattaaaaactcctgcaagtgttatgaatgttctgataatttttgttttacacacattcattcacaaacaggtaaatgtaatgtgtttattgaatgacggtcatggaatacataggcgagctttaccttaaaaataataaacaaatttgtaacaaaactatccagtgctttccaattcttttagttattaattagcaaaatagaaaattcggtctgggcatccaaatctaaactcgaaaacctacacgtgtgtgaaaatatagttcagtggtagaacatttgcttatcttaaaaaaaaacaaaaacaaaaacaaaaacaaaaagagccatctttctatctgtaacagtctgcagttcatgtttctttttcttcatatgcttcaatttgtattctatattattatgcaaaatgtacaactgttataagatctaaccgcgaaacagtatttgttaaaaggtgaggtgtgtgttaacttcgttttatattttaagaaattgtaaagtcctaaatagacattaaaataccaaagtaagttttattagaaaatacagtattatactttgtgcataataatttttaccatcgatgatttcattgcttctgcataaattacttcacaaaggagtgatacgtggggtaatcacaaagaaaatttcggtccctgtagttttgccatttttcctctacagcttctcgctgtctgatggagacattccttaaggcgatgttgccttcgtttttacacatcttttaaattatatgcttcctagagaataccaactgttgaaaacccactttcaaactgcttcgtttccacccccaccccccagccccctcccaccgccgccgccgccgccgcagtcgctgcggtcgctgtggccgctttagtctcctctccgcaagaccagccacagcaggaaatgcgtcaaaaacctgcgcagtggatgcgacgagcctgcggaggaaagacaggcttgataacgcagagtagggaaaggctcggggtgaagcaggagagtcggtgggtccgtgggagagcaacttcatagatgcagaggggactgagatgcagggggaaagggaggtttgcggagaggaaacctaggagagggacaacatttgaaatgtaaataaaccaataaaaactttaaaaaaaaaagaagcccaggggaccaaatattctcttctttgagggtttctccgagccacaaacagagatgcactgtcagactgacttaacttcctgttgtcacaggggcactgtgtgattccggattcatcttcagttttcaagttttgataaaatccgaaatcgattagctaatgaattcgcaatcatacgggttttaggagtctcggcattttctactgagctgcttttctgtagctgtagctttataaatgagccctaagtatttgcttttttaaaggaatatactccagcattagccttaaatcagatcagcggggacgggatatggctcaatctgctgtttatttttaaagttaaaatatttacattgaattttcaggaggtttgaaggcttaaaaataaaacgttcagtgtgattttcttaaatacagtgtgaatgtcctacagacgttttgcttttcgttctaacatccagtaattttctaccaatataatctctaaacaggaatgatacatacatccatatatgcatatatgtatgtatatatgtgtgtctgcgtgtgtgtgtgtgtgtatgcttatatatgatatttgcttcagtcacacaatacattttcaagtgtcatgccacgtaatgcatcttcaagtgtttatgccacagaagggtgtgtgtgtgttaattatttagtactctttttaaaactggctacagtgaagctgatgattatgacaggaaaagaaacttcaacatagtcttatggttgggacattaaggttatatcagattacatcagatattcttgatttatttatagctaagaagtgtgtgaaggatcattggatagaaaattgttatgcactaagagagactctggctgaagtaggatcaaagtaataagacttcatttggaaaatggtgcaggagaagaaacacactcagttgtgcatggttgtaatttctccctcccttaaaatgattctagtttaaatacacttttatgtaaaagtgtacagatattcagaaataaggttctagatcataaagaaaattgtattaaagaaagacaattctcacatgatgaagttttgttttttattgaaaatagattaatcattcaatatattctaattacagtttcccctccctcacccctcacagtttctccccatctctcctccctctgcatacacccctttcagtctcttgttagaaaaggaaaggcttctcagagataataacaaaatgtgacaaattttggaaacaatgcctccatagccaaatggaacctagaagtcaaaattctttggagagtctttcctagaaactacaaaatgtgtttggcttagttggagggtaatgagggtgttcagaaaaggaaagtatcacactgagcttaaataagtggctagatttgagaatcaatgctactggggaccagggaaaacaactatgtcccaatcctcataacttatgtcctcatgttaactatgttaatcctcttaacataggctgacagtaatgtcaccctatttgtatgccataacttatcttcatattttgtatgaatcataacactgcttctgaacaagatttagaatttcctaccatgtgtgtgtgaaaatttttcattacgttgatttttatattgctgtctgtcttctatgttatttctttaccctatcaagaatagagtcctaagccaggctgtagtggtgcacacctttaatcccagcacttgggaggcagaggcagttggatttctgggttcaaggccagtctggtctacaaagtgagttccaggacaaccagggctatacagagaaaccctgtcttgaaataaaccaaaaaaaaaaaaaaaaaaagagtcctagagccaagacttttatgatatggttcatatgacaggtttccatggttttgtgtcactgtcatatggtaataaattttcttaacatatctaagtcgaaatattacatttctctagccttttttattattttcatatatggatatccttctatattgtccagaaacatctgtttgtatcagggcattcaatccttttctcctgagcctgaacgttaaaattagtaactagaatggctgtttaaaaattgacttgtcactagaccaatgactcagcagttaagagatataactgtttttccagaggagccaggttcaattttctgcacccacatttcaactcacaagcatctgtctttagtcccaggagatgtgagacactcttttctggcctccataggcactggagacacgccacacagacacattaaagggtaatgccaatatacaaatacataatattttaaaaatctaaaaatacaaagtctttcattgcaattggcctattattaagggaaattgagtctatgccacaaaataatgatttaaaaagttttatcattctacaaattctgatcattctctgtacaatagaacaaaatcaaagatggaatcttctctcttagcttcctgtgcacctggaaaggtggtgaggtggaaatttcagaactaaaatacaacaacaacaacaacaaatagctttagctttttaaaatgataagataaaaaggacaaatcccaggtcatcatcagactcctcagattcttttaacattctttcctctttcttctagtcagctgggttatccctgctggaggggcttggaccacctgctggtgcatttccctgtgctgtggaaagatcacacctcttcatcacacttctagatggggctccatatgtttacaatgagcagagatactacaaacaagccaggccagtaaggcttaatattgaaatcagataatttaatgagactattaatcaattctcttattgcttgtcacatcatagtacatagtgcagttcacaagcaaaatagatgaaggctatatacttcaggctactgatgcaatgctaatcgctggataaaatgattgtcttatgacaaaacaactttatttccactgtaatcactgagcacctgtgtggcttcataagaagggtgttaggaccttctccagcttcctcttcatagctcttctctagggtgtccctatatcattctcccccatgtaagggctccataaaaaatcgccccctacttagttgtatgctgcaaatggcccatctcctttctctgctgtatagtaatctcactcccttcaatatgtccttcctttgagctggtcacatcatgggctgatactgtacaatctgaagataaactggcctaaaacatgggacagctgcccagccatggcccttgctcactcattggtattgccttccctgtagtattccaactaatactttcttcttgggttgattattctgaatgtcccatttcttgattgtaatttcttccagtttattgattgtaaataataaaaagggaatgtgattaaaaagaatgagtagctaaaatcatgcaaattaaagctatgaaagacaaggaaaggattactgatggtattattgtaattaattgtaaataaattgacaattcacaaggagaatatgtgaatttttttatgacaacaggtgtgaacgccatattttttggtgtggttccttttgtcatcacctatgtgcgtgcctacattaaaaaaaaaacctactaaattatagacaaatttggatttcagagaattagaatgttggatgggggaagggaaagagaagctagaagaatatcctgtataagaaaagaatgtttataaaataggaaatagaacaccttcctaagcctaagggaaattgatcataaaaaagaatatacttacagagctcagacttttttttttcttgtttttttttttcttttgcctgcaagtgtctgtaaaaaagatcctaagaaaaaacatccattctctctcgttctgaaagaaaacaattctggttaaagtttaggtttccttgtaacctcaaaagcagttttcagaattccatggctcattgtgttttaggaaatcagtgactgccttgtgcacaccgccatctaccgtccaaaaattgaacatgcctgagaaaaactcatttaaaagtccttgggtgttgttgttgttgttgttttatttgtttacatttcaaatgttgtcccccttctcggtttcccctccacaaaccccttatcccgtcccccatccccctgactctatggagatgcccctcccccaaacacctacccactcccacctctccaacctagcattcccctatgctcccctcttattgatgctagataaggcagtcctctgtaacatcttaggctggagccatggggtccatctatgtgtattctttggttggtggtttagtacctgggagctctagggagtctggttaatttatattgttgttcttcctaaggaaatgcaatcctcttcaactccttcagtcctaactctttccttagagtccccatattcagtctggttgttggctgagagcatttgcatctatatttgtcaggctctggcagagcctctgggggacagctatactaggcttcagtcaacaagtgcttcttggcatcaactgtagtactgggtatggtatttgctgatggaatggatccctaggtggggcagtttctagatggcctttccttccttctctgtttcactcattctctgcattttctttagacaggaacaattctgggttaaaatttttgagataggtaggtgaccacatccctagagaactttatgatttgcatttccttgatgacttaatgtgaaaaacatttctttgagtgcttcttggccatttgagattcctctgtttacaattatctgtttagttatgtattccacttattaattgggctatttggttatctatagtctacttttttggttttttttttatatatattttggatactagacctctatcagatataaggttagtgaagattttcccaatctgtaggctgttgtttaatcatgggctccagagggagggagggaggtacctgggtgtgaaatgcaagggggagggggaaagggggacaggattaggtataggggcagataggagagaggtttaaagacatggaggaatgaatggaaatatgcagatgccaagggtaggggagggggtgaaacactaagaagtcccagagacctgggatggaggaagctcccaggactcagtgggggttgccaaaccaaaatgcccaacactgtggatatggatcctaaagagaccacctccagtagtcagacaggacccccagtggcaggatggacataccaaccgacatgcacaacttttgacgcaaaattgatcctgtctaaaagaagtgcaaggacaaaaacagagcagagattgatggaatagctgaccagtgacctgcccaacttgggttctatcccatgggtaggcaccaatccctgaaactattactgatgtcatgatgttcctgtaaaaaggatcctagtgtggctgtcctctgagaggctctagcagctgctggttgagacagaagcagatgtttgcagccaatcattggactaaggtcaaggacccttgtggaagagttaagggaaggattgaaagaactgaagtggatgcaaccccataggaagataatattgttatttttatgtttccacaaacatgaatcaataagtgtatataagcatgagcatatatacatttcatacattactgtgccatttattcagttgtacttgttttgtgatagttattcttaactgattgtatgtggtatactaccataaatatttttgtcattagctgttctatgattcacaagcctagaagaatttcttaagtcaagcttacatacattttggctgtttgatatatattagatggagtggtctgtttatttagtgaaatcaccatatggtgttcaggcccttgatatgctactgacatcagtttcactagcctccttcagagcgagaaaggaatatttttcagtgttgtttccaatttgctaaaaggtgaatattcttggggatggtacggagaacctaacaccctatagaaagaatgtgtactgtattaggacataatgagaaataaaggagtgtggcatgatgagaaatagagcagtgaccctctcctgttttactttctgtgtttgagtcagtttaaacaagctccaggaagttcaccacaggtctcatatactgatcagtcttttagcaagcagcccaaagcaaaaatctttactaattttttcttcttctcaatatttatctttggtctttattttttctaaatattagattggttagatattttctctttgaagtatggagtatgtggattgtaaaaaactgtaatttctatggaattatttttgtcctttctcttcaatactaaagatttgcatttattcttattattttaatctgaaaactaacaattatatgtagtagtgcatttttgaagctgtattttattttcttttattttatagttctttggcttcctactgattcttttttattttgtagactaccagtgaattaatttagtaggaaatttgtaggttcaatatgagtaaattcttgaaattgtataattttaaacgataatttataatgagtgtttacatgttggagaatgtttgacatttgaagaattaaaaaaaaacagagaatcagagaaaaaaatcacatattcattcaaaaacatggctggggacataaacaaaaggagcattttcaagagaagaaactaaactgaaaagaattgtgtaaaaaatatttgttatcccgagtaagtagggaactgcaatcaaaacaactctgagatttatccctcccaggcagcatcaccaaaattaaaaaaaaacatactgaaagtgtgtggggacaagagaaacttcatttactttttgtaggattccaaacttgtattgccattatgaaaatcaatgtggagaattctatcaagatgaatgtgtatatgtgtgtgtgtgtgtagagtgtatatacatatgctaaaatcactcactatcctcctttataaatgcttgcttagtcacattgctgctctagtcacaaactcaacatagctcgaaaatggaaacaacctaaatatctttcaactgataaatgaaaaatgaatatatggagagagagaaaggaagagagagagagagagaattgtgtatgtgatactgttcatctgtaatgagagctgtgtatgtgatactgttcatctgtagttagaaaggaaattatgttactttacaaagataaatagacctagaaacagtcatattggatgagattccccagaccaagacagacaaatctcacatttcccttattggaggcttctatctcttcctggtcttcagatgtgaatacataccatgaagtaacagaagaaataataaaactaaaatggagttatttctgcggtaggtgattgggaaagcagagagtagagtacatcaggacacaagtcatatgacaggaaaagagaacagggctttaattaggaaaaggaatgtagacaaatacagaaaagcaagtagggggatagaagaaaagtgagggtgtctgggaaaattatttaaaatcatactattaactattttcttaaagtaaggaaagaaggaagaaaagaatgaatgaatgaacaaaaaacaaaggttggaaggaagaagggagggagggaagaaggaaagaaacaactatatcacaggtatgtatgtaaatgtgcatatgtagtatccatgacattttttttatattggctggcagtgttccttctggtaaaatatcacctaataaaagtcccaacagacaagagcagaccaattttgaattattggtcaagcttgcctaattgactccccaaaccaaattatccaagtctactcaagccatgaattttaaaaacataaaatcaccattctactaaaccttcataattccttacttcaatatatagatgtgtctttatacccagttcagagtataggtctgatcaaaaggagagtacatatcagatctgatgagtattattctgtccaaaagcctaaggcatggggatttaagtagctcaatggtacaatgcctgaacagtgtataagtgtttctgggttgaaataccagaatctcagtgaaaattaagtttgtagcacaagcatgagagctcagcctttaaaatgacctcaagccaagcctgtcacgcagagttctatcccagaaaaccttatgccaaagaagagaatttacttccacaagtttctcttggaccaaagaaaacacctactcccataaataaatgaaaatttaatgacttaaattgaaggaacacgaaaccatcagtttatcagtaatcatgctgatttaaaaaaaaaacagacttattttcagacagatttattttctgatcatggttcctcccttatcgtccctcaatttgtctctttgtagaaaatatataggtatattaaaaaacaaaataaagtaaaataaaaagagagaaagcatcaaaatcacagacacacaaagattcatgcctttacacaaaccccataaaatgcaaaatttgaaatcacaataaaaaagcaaattactagtaaagaaattcaaacacagtcagaacattctgagttaactaacaaaatactgtcaaaatagcattgagttcatatgagttagctggataaaacttgtcatgaggattccatctgagtgtggtttatatccccgttgattcaccatcacggtaaactagttttcctttgtgagtagtcatcaactggaggtggctttctggttagaagtgattgattaggtcgacttccttctcttggcactgacttgaatctctgcagatcctgtgtatgctgttctgatctacttgagtcagtcttttatttatgtgtttacatttcaaatgttttccttttttccatttcccctccagaaccaccctatcctatccctctccctgctgcttctaaaacagggatcccactcccacctacccactccaatctcctcaccatcctggtattcttaatgtgcctagaaggcattgtttccatggttacattcctccctgccacactggctattagaatctctgtaactgtcttctgcaaagtttcctaaccatacaatggagtttggatagatataactcatttatgactaggtgatccaatgtctctcattctatgtacattgtccagtctaggtttttttttttcctttttgttcccatctactatagatggcagcttctctgatgaagcactgattgatgggttatgacaaaatgtcattaagaatcattatatttcttcatttcattagaacaagattatttgaccttctcctatgtccattaattacttagttccatatgtttggatacaagaaatatttttgttctcatggagtgggccttaaatccaatcatacaataattgttcaattccacaatatttctgccactattttaccagtgtatcatataggtatgtcatgattgtagatcaaagaggttagaattgggctggtttctaaattaatttccagaaagcatgcaaaatacttcacagtaacatcattcatttctattcgggtggagggaaggtttcaattaggcacatgcttgatttctctgtgttcagtgagacaatgcggacattgttttcctcaatagggacataccatcagtttgtgttggtaatagcctgactcttttgagtgtttccatgaagaatctttgtccaaaaaatcaattatacataactcatacctaggattaaaggtttcatttaatgagaaatgagtagttcagggattctttcccagttagttagttatttgatttatatttttcatctatatatattaacatgatgatccacagttctatttttccatctcagtattccatcccttatttatccccaaatttatcatctctccctattgtcttcatttttatatatgctatttctacttccacttgaaatccttcactcccttcaattatcttttgctataccttacctttgtaaatttaaggattcataatgcttttgagaaacttaaaacttaatatttaactatgagggaatatattcacatttgtctttaggtttctgggtacctcactcaggatgacttttcttcaatttctatccatttacctgtgagttccataattttactttttttaacagctgacttatattccattctataaatgtaccacaatctcattattcattcactactttttaagacatctagtatgttttctatttctgactagtatgaatagagcagtaatgaacatgggtaagaaaatttctttgtaataagtttgtcctaatggtgtattcccaagctggatcttggagtagaactattcccattttctaaaggaacctgcacaatgatttcaaaagttgctgtaaaagtttccatttccaccatcagtgattaagaattcccctttctctgaatcgtcaccagcatgtgttatcatttgtatatggatctttgttatcctgattaggggaagatgaaatctcaaagtggttttggtatgcatatccctgataactgtggatgctgattactttaagtgaaaccagaatttgaatggccacttctgggtcattggaggaagcaatttataattgaatacacagagataagtaggggggtaagccatggaaattagaacaaaggaagacaatggaaggattactattcaaagagtaactattgagggaaaacaaccaaattgcatgagacatgccactgagggaaataataaacaattttaattcatcataatatatatatatatatatatatatatatatatattacaattttttgttttatcattaaaacggagatcacccagcttaagaatagccctttataatgagtttatagaccctgtgcagttgagtggtgagggatggtaaaaacattaaatttagagtgagattttaggtagagagagtaaaatatatgagagtagcaaaaggaaagagactacaggactacagcacaagaaataagccaggggaagatgtgttcttggtgcagaatctccctttgctcttaatagatctcatgttaaaattaccagaagaaaacatgttattttcgcaatagattacatccttgcccttataatgatatgccaagcttgaacaagtggttacctctgtactcacagcgccatctagctttcaacaaaacggaaagattgatggaaacctcttcaaaaggggacagggaggggaagaggggagtgtgaccagtaattgggtaggagaaaaggactgaagccctgagagccagcaaagagtggagaaaggcaaccctggaaggtaggaggtagagggatccttcagaatgtaccagagacctgggagctgagagactcacagaactcaaagggagggaccttagatgaaatgccctacagtagggagagggaacttgtagagcccacctccagcacaaagcaaggcattaagtaaaagagggtttgccatcccacagtcaaaaactctgacccataagtgttactgtcctaaagaactacaggggaataaatagagaagagcctgagaaaaaggaggtccagtgaaaggcccaaattgagatccagctgaaggggaggcccaaaggcctgacactattattgatctatggagtgctcacaaaaaggtacttatcatgactgccctccaaaagacacaacaagcagctgaaagagtcaggtgcagatatttacatctaaccaatggacagaagctacctgacccctgtggttgagttaaaggaatcctggaagaagctgaggcaacactgtaaggaggaccagcaatctcaattaacctggacccccaggatcaatcaaacactggaccatcaaccaggcaacatacaccagctattacgaggcccccaacacagatacagcagaggactgtatcaatcagagtagatgtgcctaactctcagagactggaggccccagaaagtggagtgtctggtggggtgggagtgggaggacatcctcttggaggcaggatgggagggagaaggtatggaatgttgaacagtcaaagggtggactgggataaaatctggagttaaaaaaattcagagacccaagtataaaaaaaggctgtgcttatttcaacaggaattaaattcatttcaacaaaatttaaatctcaaatcccaaatctactgtcttatttctagaggagataactaatttatgttagctttcagaacatacagtgtactgatgcaagacactctttgctgtcccatcatacatagacggctaaagagtttaaggttaataaaaattctttgggtctgactgattaaagaacagatacacagagatattttgccattgcacatacaaaatgaaaatgtaagagtgaaacaaatttaactgaccattgtatacatgttatttttgatccagtattttctggcacacacatatcacttcagttacactagaattcatataatcaacgtttcattggcccaaggtttgagtctaattgcctttaaaacattcttttagatgttcctcaactgcagaatggataaagaaaatatggtatgtctacacaatggaatgctataaagctattaaaattcaagacattatgaattttgcaggaaaatggatggaacttgtgaacatcatcctgaattaggtaacccaggtccaaaagtatatggatggcatgtacccacttataagtgaatattagccataaaatataggtactatgctacattccacagagaaaaagaatcaaggaggaaggcccaggtggggaagcttgaatctcacatagaaagggaaataaaatcatcataaaaagcagatggagagaaggaaatggtaggcatagagacagagaagtgaaacgaaggctcaagatcaggtgtggggaaggacaggagagatgcctagatagccatgaaagtgaatgggaatctataactggggtgaggaaggagggcatcttcaggacaagacagagttttaggataagggcgacacccaagaatcattgtgggtggccttaatgataacacactacacaggggatatggaacacaaagaggctacatcctatagccagggaagaacgccagtagaatgatagagataaaaaacaacccacaaaactttaaacccaaaatttatcctctctacaatatctccaactcataattgttcctgtgggaaagaattacagggatttaaatcgagaggagactgataaaaaagaaggttcagcgacaggcccaaagtggaattcagctcaaggggaggttgcaaggcctgacactgttactgagggtatgggtcactcaaaaaaggacctagcatgactgcccctccacaagatacaacaagcagctgaaagagtcagatgcagatatttgcaccctgtggttgaattagggaaggctgaaataagctgaggtaaagggccatcctgtaggtggaccagcagtctcaattaatctggacccatgagatctctcaaacactggaccactaaactgacagcatataccagctgatatgagactcccaacccacatacagtagagaacttccagttctgtgttcattcagagatgattcacctaaccctctagagactggagaccccagggaatttggaggtcaggtgtggtgaggagtgtggatatccatgttgagacagggggttagggaggaggtattggatgtggaacagtcagagggtggattgggcattgggtaataaaatatggagtgttgaaaaaatattttccaactattaaaaaaaagaaatgcagatacagggtatggggtagatactgagatgaccaaccaataatgagctcatcttaagatccatcccttgggcaagtaacagtctattaatgatactctgatatggttgcagataggagcaagttgtcctctgacatggtccacccagcagctgacccagaaagacacagacacttacagccaaacaatggatgaagtttgtggactattatgggaaaaatggggaagaattgcagccaataatgggatagaaactacacagaaagaccaccatagttaactaacctggaaccttgtggctctcagaatctgaaccactaaccaaagaacataattgggcttgaactagacctccccttacataacacttgttgcagatgtgcaacttggtcttcatatgggtcctgaacaactggaaaggaggctaactcaaaagccattacctatatgggggatgtgttcttacagctgagctgcttgtctggcttcagtgggagtggaagtgccagatatttgaaatgccagtttgagggggtaataaataggagggctcacctgctcagagaagaagaggaggtgggtggggcaggattgtataagaattgatatactagtcggatgggggcactagtgggatataaagtaaataagctttaaaaagtaataatttaattttaaaaagaatgataattttttttcaggactcctaaaatcacgtgggtttttcttttttgaaactgatatatattttatctgattctcaatatcagcataacaaaaatttaaattagacgtagaactctttaacattatctttcactgaaatttatgaaacaggtgattttgggatggtgaagtatcaagttataattcaattagtcaacaaaataagagccagggaaagaaaaaagtcctagtcttcataacttgggccaacaatcaaatatccctatttacttatcacaacttatattcatatagcctatatattataaaaaggcttacaaacaaggagatagattaagattggatggcaatgtctcatttatgagaggggaatccatgatatttcactctgtatattgtccagatatgggtctttgtatctggccccatctcctgtatatgctaacttctgtggtgacaatggtgcaatatactgatctatgggtttaataacaaaatattattagaagtcattgtgttgctacatattttagcagacaatagtacctgctttaagccttagacttggttactttaacatgagaacaatgtcaaatatgttttctgtctcattgtgtaggtctcaaatccagttagatagtggttacttattcccttgaaggggccactatcacagcagtgtatcctgtaggcagctgagtgtagtagatcaaatagtgtaggactgggttggtatttcaagtttcccctcactaaccatacagaatacttttcagtaccaacaaaactattcatcaggtaaaggctttagttaggcaaatgcttgtcttctctatgttcagaagaaatgtaggtgttgtcttcaacaatagagctatgctcagtttgtgtggagcaatcagtagcttaggcaatggtttgatttgtttggggtattaccatgaagacacattggccaagaaatatattagctataacccatatatgggattgaagatttcatttggtggcaagggaagtctagttgggtcattcctattatttggttattctttaagatttttttaaatattacatcttttagatgttatgtattcagtctactgtggtatctttcagactgatcatacttttagctgcttccattagtatttgcttaatcctcttcacttccccccatccatttaattgccccattccagtatcacctccaaatagtcccataattatttatattatttctaaatcctcaaaaaaattcttccctccatcctaatttttgcatgccgttgtcaagactttaaagctaatatccaaatataagctaataaatactatatttgtctttggggttctgggtaactcagaatgagatggtttttcgtttgttttatttttttgtttttgtttttgtagttccatccatttaactatgagtttcattattttgcttttttaacaggtgggtaatatttctttaaaatatataccatatttttattatcaatttctccactatgtataggtatttctaactattgttaatattacagcagcattgaataggaactaataaggaatgctataatatgatatgtactcctttagatatatgcctaataatgatacacctggaacttgaggtataacatttccagattcaaaacagaaaaccacacagattttcaaagtggtcatacacgtgtgtattcccaccagcaatgcataaggattcttatgactcaccatcctcaccaacatatttggtcattcattttattggtcttggccatactgataaatgaaaaataaaatcacaacatggttataatattcatatttctgattactaaagatgttgaacatttctttaaatgaaaccagcacttgaatggttaattatgggtaattagaggaggagatttatatttgaataccaaaaggataagttggtgaaagacatggaaattagagttacaaaagacaatgaaaagattagtattcctagagaaaccataacaaatagagcgcccaaaagctttggagcataattcagatggggatattaagcaatttcaacacacacatacaattttctgatttcatcgtcataaaagaggcaagccagattatgaatacaaatttcttgataaatataagcaacatgtaattcattagtgggggatgagaaaccatgaattgctaaacataatgggcagatatttcatagggaaaatacaaaatctgatagtagggaaattagcctactccaaaggaaattgtcgttaaaaatgtattcttacagcagaaagtcccttcaatactcacagatcctagacacagatttgattcttgcccttaaagcctgaagccaggtttgaaggagtgattacgtctgtgctcacagcgccatctagctttcaatgaaacaggaaggttgatggaaacatctacaaaaaagaagaaagcaatctcaggagggtagaaggagggagggacctggatgggaaagaggacaggggaacatgatctggtatttggtggagggaataagactaaagtcctgaaagccagcagacagaaagggaacaggcaacttcaggaggtaggaggtgggggaccatccagattgtatcagagtcctggtagctgagagattcttaggactcaaaggaaggaatcttagatgaaatgtcctacagtgggaagagggaacttgtagagcccatctccagcagaaagacagggcatcaactggagggatggggttgccatcccacagtcaaaaattctgactcataattgttcctgtcttaaagaactttagggacaaaatggagaaaaccctaaggaaaaggagatccagtgataggcccaaagtgggatcctgctgaaagggtgaccccaaagcctaacactattactgatgttatggagtgttcacaaaaaggggcctatcatgactgcccttcaaaagacctaacaagcagctgaaagatgcagatatcagatgcagatattttacacacaaccaatcgacagaagctgctgacccctgtggttgaacttggagaaagctggaagaatctgtgtaggagggtgaccctgtaggaggacaagcagtctcaaatcacctggacccccaagatctctcagatactgaaccaccaacaaggcagcatacaccagctgatatgaggcccccaacacatacacagcagagcgctgcaaggtctgtactcagtcagagaagatgcacctaacctcaagatactggatgcccaaggagtggggaggtctagtgggatagagttaaggggtatggatattctcatggagatggcaggggagggatggaatgtgaaacagtcagagggtggatgggggagggatataacatctgaactgtagaaaaagatttgatacttttttataaaagcacacaaatggacccaagaatattaaataactgtttttttttgtttctaaaatggatttaaagaatcatttcgaagccaaaacctatactttgatttctacaggggatatctaatgtgtgctcaccttcagagacatgggaagaatgatgcaggtctctgttagctaccacatcacattacatacaaattttaacaatagttaaagttcaatgagaagcctttcatgctgaatgacagaaataatggatggagagaaatatttagctatgagtacatacatagtagagatttaaacatgaaagtgatttaattgactattattatgtgtacatatttattcttcattttgtatggacatattctattccatatatttctttttaatttcggttaccctctgattcatataactaacaagactttattaaatgaaactaagaaactggaagaatggcaacacacagtcatgaaggaaatagcagtatttctggcaacagtagttgaaaatgccttctttagggatgacgattaactcttccagtttggcccaggacatgtgctagttttcattagggctgaaaaactagatctgtacaattgtagtgggagtctttctgaaaggaagacagttctcctggcaggtggattctctttgtttctcagtgcaggcagtgctgagaagccaggatgaagatagcccatccctccctaggtttctttgttttgtatgtagggcaaaactttctgtccttaaatatacctctcttcaattgctcctcaaaggttattgcttatcaaagtcttcaacctgtatcccatcattaaaaggtttctatttagattgcttgtttatgttgaagtctttgctatctaactttctactaacatcttataagctaagtctttcctaggataaacaattctgtttctagtgtcctttggctttatttacaaaaagtatggtttttaaatgaaaactttgaaatcttgttagtcagtttcagtgttaaatttctgttattttacatttaagattttctactatttgtttttaaattcttctctcattcattaaaaatcctatgctttcccctccctcctctccatgcagtcctccccatatctttcctgtcatccacatccactcctccaacatgatcttctaaaaacataacaaaacaaaaaaagagcaagtttctcagtgatatatcaactaaacatgtcataacatgttacaattaaactaggaacagccccctcaacaaggctgggtgatggaattgttcagtgatttaaatgttctgggtgacctaattgaaaggatgcattagatttccttgttacaattattgtttaatctcattactggagtattttgatgagagcatttagaaatagaacaaattatgaaagatgctttctaggcaataccaactggtataaacacacattaaagttactatgtccatttcctttctgtaccctccaccaaaagctaagatcttattgcagcgacctgagccagccagtagacccatgataggaagtcataaaagcactgcacaattacacctgcctctggtgagtgaaaatatgatgaaactacaaggaccaaagttccttttggtttcaacctccactggtgtcaaaaataaaagtcacccccatcatctttaagatactctggtcactggagcataaccaagtgatttgatttttcatatttcagatattgaatttcatcattagaatcttgagttttcaataatattaatattagaagtcctgccattttatcttaatcttgttttctttagacgtagatttacaaatgtgtactaacaaaagtttttcttttgtaaatattgacacaaagagttcagtattaattcagggattaagaagtcatgagttaatcagaccaagtttaaaatgaaaattttcatagaattttcaagaggtttgtaattttaaaaaaaaatattaattttaatctgaccccttaaatacaatgtgtatatctaacacaggatgtttgttttttaacacttttgccaaaatgactctagaccaaaatatgagagacaaacttttatagcatatatttactttagtgccacattatccaccttaaaatattataccaattaccttatgtttgcatgtgtattctcaattattttaagcagtttgtttcttttaatattcattactacttttacactgtcagtaaagctgttatttatgatagcaaaaaaaaaaacttcaacatagtcttcttgagacattttggttgtatcaaagtacagcataggatcttgggaattcatttatagccaaagggcatgtgaagggccagtgggtagaaaattattgaatactgaggaagactgtctcaagaaggatcagagtgatgagatatcatcttgaaagagggagggatgagaaatatattcagatgattatggtggtggattatttctcattgaaaatggtccttattaaggtagaatttaaagtgaaagtacatacataacataaaaatatcctgtataaaatttaattgtggaaagaatgtcatttttaggacatttaagaggcttgttgttgttgttcttattgtttctgcattttttattattaattacttttattacatttcaaactttgtccccttcccactctcccctgtgctaccccctcacctcattcccctcccattttcctctaagagaatgctcccccacccactcactaagcacctcacccctctagcatctccctttgatgaggcaacaaacttccacaggaccaagagtctcccctcccaatgatgccaaataagtcagtcctccactaaatatatagccagagccatggactgactcatgtatactctttggttgtggtttagtccttgggagctctgaggcatctggttagtagatactgttgttctttctatagggttacattccccttcagctccttcagaccttcccctaactcttccattggggtccccaggctcattccaatggttggctgtaagtatctgcatctgacttagtcaggtgctggaagagcatctcagaagacagctataccaaactcctatctgtaagcacttcttggcaccagcaacccagatgtcctttaatggaagaatggatacagaaaatgtggtactgttacacaataaaatactactcagctattagaaacaatgacttcagaattttgcagataaatggttggaactaaaaatattatcccaagtgagataacccagacccaaaaggaaatacatagtgtatactcactgataagtgaatatattggctcaaaatctcagaactcccataatacaaataacagaccatatgaagcttaacaagaaggaaggccaacttgtggatgcttcaatcccacttagaagcaggaacaaaatcatactgcttctgttatgattactttcccttgcattgtcaggagtcaatctctagaagtttatacttttccaaatgctcttctggtgtttaacagtttcattgcaataattaaagtttgtttagtaaaatctttccttttctttcttttatattttttgagacagggtttctctgtatagccctggctgtcatggaacgcactccatagaccaggctggcttcgaactcagaaatcgcattcctctgcctcccaagtgctgggattaaaggcatatgccaccacgctgggctaaatctttccttttcaaatgtatctcccatttctagtgaacaaccataatatttttcataaatcttaccataaaatgtgagctttactgaaattgatatacttcctcttgttctcaatatcagcatagaaaaattaaaattaaaaatcaaattacttgaatttaccctttcactggaacttcttttttattttttgtagaatttttctcatttatttatttttattagatattttctttatatacatttcaaatgctatcctgaaagttccttataccctccctctgccatgatcccctacccacccactccaggaacaaccaagatacaatttgcaaaacacaagaaaatcaagaagagggaagaccaatgggataatattttattcctccttagaatagggaacaaaatacccacgaaaggagttacagagacaaagtttgtagctaagatgaaaggatggactatccagagactaccccacatggcgatccatcgcataatcagccaccaaacccagacactattgcataatgccagaaagattttgctgaagggaccctgttatagctgtctcatatgaggctatgccagtgcctggcaaagacagaagtggatgctcacagtcatctataagatggaacacacggcccccaatggagaatctagagaaagcacccaaggagctaaaggggtctgcaaccctataggtggaacaacgatatgaactaaccagtacccccagagctagtatctttagctgtatatgtagcagaagatggcctagtcggccatcactgggaagagaggccccttggtatcattagaacctctgatacaagataggaggtatgctgagatctgtctcagtcttaagagccagccagggagttgtggatatagggaaaagaactgtttcacagatctcatatcatagagtgacacaaattctattgaaatggtcaatagttcactttgacgtttatgtccgtatgtcaataatttcctcataaagccaatgatgttaggacatagttcatataacatcatttcatagttttgtatcactgtcaccagatgaggaaagtattttctcttttctgttagaaatatatttctctgtgcttttgcaataaattcttaacttgtggaaaaactgtttagactgcaacattctctgaaggtcatagaggctttcaaagcatttatattaaaatttaaggaggttaaatgttaacacttgtaatattgtcattaaaaacaatgcctttgccctaagggatttctcagaagttaagagtgctgactactcttccagagaaactattcaattttcatcacctacttttctccttaccatgatttgttttaccagatacaagggaactgcagcactcttctggctttttcaggacctccaagcatctgctccatagacatgtattcaaacactaatacaagacaacaactaaataaaatagaattttttaaaactcaacctatgcaagtgtcatacttttcagaaaactgagtctaaatcagcaaaaatgatttatttttaggattttattaaattttggaatttattgttattcaataaattctgactttgtgaattatcaaaaatgtctatcaatgactttagtagtatgcttatggcacagaaaaatcctgactatacatgattttcctaccatatgtttctctccacttttgctggaggaaatttgtcctctgcaatggtatttcctgaagaagatgattagaaatgcagtgaaaatggttctagtgatatttcctgacaaaccatctttgtttataaaccaataaaaaactcaactcactgtaaccccatatacatgagttttactcatgatggattgctttatgctctatgtgaacttctggtaattcctaattcctgtaaatacagggcttggggtataggtataaggctgggttttagggaaataaactattaatgaaacgtacaataagctagaatctgcattgtacagatattctggatttcatattgccaattgcaaattttccaaaagaaaggtttattggttggctaagcaaagaaattaaagatggctgataggaaagaaatcagtaagatttgacattcggtgatttcaaggccagcctgtttggaggcatttgaccaccatcctctatccagtaggaaatcacaaagaatttccaattatgtctgcacacatgtgcacctggtgagaactttggtggaaatttcaagatgtttttgaaaccatatgattttttaattgaacatgctagcaaaaatctaccgtggttaaaaaaaaggaaactgtactaccatcataattcttagatgtctctttctttattccactttctcttcagctttggcatcagtgctgcaggaatttagatcatcttcggctgtgccttcacgtggtgaagaaagctccccactctattgaaaatggtgctcacattgctgacattggttaggcctattgcacacaagccaaactaataaggtccaacaataacattatgtaccttaattagaatgttgatcttatcctctaagacagtcaaattgtccctagctacatcctaacacaggctgagtacagaatagatgcaggatatacttaatgctcctgacatagtgttagtcactggaagggaaatcctcatctcaaagatgcacccctgccttccctatgaagcaccaagcaccttggtgccattagacatatagcattaggatctgacttaagctgctgtgtatagtatctttgtagcattttcccatcactttctccactggaaaaaagctctctcaaaatagctgtctacttagttttcacgagcacattggttttttgtttgtttgtttgtttgttttttcatctctgtcatgtgtcccaatctcaccaccttcaatctctccttcattcatattgaatttgtcatggctatattatgtactggatatgctgaacattaaaactgcctaaatccagtggaaaacttctcagccatggccctggctcaatcacttgtagagccttcatttgctctacaatcatgcaaggaatatttcttgctattggattttatttgaccatcattttccttccagatttcttgaacaaaaatagttttcttctttctactgcagaatacaatcctgagtccatcctcattatcagctttgaaacaataaggtcattgacctttgtactttttatttggaaaatctacctcttgatgatcagtgtggatttgtcacaatctgtattaatcagccctacttcctttgagtattcttctactttgtaggagtgaggcaactggaaaacaggaaggaaaaattgatgacctgaggttgggtattcggtgattcttttgagatgacttgtgaataatttcttatcagctgatctatttcctctagcggctgacatcttcagaatctactgattcttcagatttatgttgactaacatctttctacatgtcactctatttctcttctcttctcctctctctctctctctctctctctctctctctctctctctctctctctctctctctctcatttctttttcattacatatataggcctctgcttttaagaagaacacattataatttttattcaatctcttaggaaatatcctccagaattcctgttcttcatgagctacaccttctttcctgaatatattggaggaaatttcaattcagaaatttcaataccagagcaactaaagtgaaaaccttgctttattgaataatgaatgctggccattttggtcgaaacaatcaatcagttgtgataaagacagaccagcatcagaagtctctgggaagtgatgcttcagggtcagcatgcagaaactgtgttgtaaaaatgacaaggtcataagtgtgttccataatgaacttattagtgactagattaatcaagtggcactggatatgaaggcatggagacatcatggacaggcactgaggcttgtaaccatgtggcagggatgggtttcactactgttttcagtgaaacccagttgcttcaaggtacctcagtgttttgggtatgcaagtaccatagaataaccagaaaaattagcagcagccatggggtcaaggcagtcataacctagaatactagctctatatttgttgcagagggcagagctagaggcattagttacccagaccctttaaagggtagcaggaaatagtcagtgggtcacagatattaatatatcgagttattaacactgctgaggattgatttttgctttgttcacatttttgcttgataatacttccttgaagaaaaggagtacttaaaaaaacacaaaataggcagttgctagatgggtgaggcaggagttagtgagttttaggaggagcactctcatagaggcaaagggagggggaaaggggagatgagatggggatttgtgcaggagtaatgaggaagggggatatcttttaaaatgtaaataaatagaattgttaataaaaatattaaagagaaaacatatttttttacaggatcccattcttcaaaatgagatttcagaattttatagagaatttggattttaaaagacattagttttttttaaagatactgaatttttaaaagtgtttgaaatggccaggttgtgagactctgtaagtcctactagtatagatacatttgatattcaacttttggtaaagaactgactaccactcacaatttttgtgttgatctatatcacaaatgcaggtcatatcatacacataggaaaatacagcatccagaagttagaggaagaaaaagttgaagcttaaagtcaacctaagcatttctcaggacagcctgagtccattgcagagtagaggtaatatgagatctgtgccgttatgtgctggagaaatgtaacttgcttttgattttataggagttacatagaacatattgacttgaggctcagaagacactttgaacttttaaacattattcattctctgaaagatgatgagctcttttaaagttttacagtatacaattttattatgatatggttgtgagactgtgataataaggtgtacagtgcagtgttttgaatgagatgcccactatttgtctcgaattttcaaatacttgactcctagttgatggctgtttggggaagattagaagatgcagcattgctggacaaaagatatccctggggatagctttctatctttcaaaaatctcatgatgtttcaaagcattctctcttcttcctctctgtggtttgagatataagctgctacttcagcaaccatctgcttgccactcaaatagagaaagactggacataatcttttgctactataattttaattttattatttatattttattgttaatacagggttcaaaaatgtaatcctggctgtagttaaacacaatatgcactctctatatatggcttaaatatatgtgccatgatgcctggactttttcactaaaatattaattgtaaatataattaatgattaaagccaaatgcacatttaaaatgaaaaaaaatcattgtatattggcttacatttgtaaccatataattcaagagatataaacaaaatgattactaaatgtttgatactatccttggatacagaatgagattctttctcaaagttccaaacataaagaaggagtgaacaaaaggaaaaattaagtaaagaggaggaggaagaatgagaggcctctaatattcagatacaattaaaatctcaagacacatgagttaaatcattgtcacatgcaaactagacttctctggtatgtgaatgagtgagtttttggaaaaattgagcatataaaattagagatctctggagagaaacaaaaacagtaagtacacagtaatgtaccctgctctttgggtcaattttgagatctattaatttcactttgctacaactcttctagtgcccatgttacatagtcattgaattcagcaatataagtcctcttcactatatcaatatggtaatcagtacacagaaatttatataacttgcaaagataatactgtcaattctataattagaataattagaatcaaatgcaaaaatttaaatgcatgatatatatacatagaatatcatagtatagattacattgtatatgttatacaagtctttatccttaggtattattgaaatagttattctctctttcaacttgaagagatctagactcatctgtgagacaagcttctatcataattgagtgagattagcttaactaacctaatttaggtaggagaacatgtccttatgggtagcacaaagttgtggacccttaacactgtcctcttcactaacaagttggatttctgtgtcccaagcaagaagtctaaaacccaaatccagcgattgacacttctacatacatacagacaattacttattactttttagataaaaatgtaatttatttaaaaatatagggctttctctatgtgttttcagcatcctaatgccaccttgactcttattatattaagagctttaaaaggtcttggattcattttcttttttagctaaccatatataacccttgtcttttgtcactattgtataaaatctgtaaggtatattaactcatgatacgacaatcttatatcttaatatgataggatgcagatgaaaatagaatgcttttaattctaggtctatctgttcgaaacaatatctccctggtcagaaagtgctattgatgctaacattgtctttaaaaataataaatcagtctgtcttattgagtacttgtttcaaggcatcttctgacaactttcatgaagacaacaccactgcattgtagtttcattgtctttttcctactaggaaactatatttgaaaggtatctaaaagtgcaagatgacagaaaatagtatcttttcaacaagatttaaatttctccaccactggcagaggttcagagggactaatatccaggagcacagcctgtttaagtgtagtcatatccttctcccaatatggcatgaatttatatattactatacctaactgttcattcctacactgcagcacatttagtcacacagggagcttctgaaagttctaccatgggaaagtaagcagggtatttaaatttgctttcaatgccacatttatatttttgtagatctctttccttccataattttataatgaactgtatagagtgtgcaaatataaatcacagtttgatgtgtttcatgaagccatggaaatatttttgtggagtgcatcccttccttcgaggtaccaaccataggatggttctagtataggatagagtttatttgggggtatagaaaggggagttgataaggaatagagactgagaggaggaggaggagagacagaaagagagagagagagacagacaaacagacagacagacagacagacagagacagagagagaagcggagaggagaggagaggagaggagaggagaggagaggagaggagaggagaggagaggagaggagaggagaggagaggagaggagaggagaggagaggagagaagatatgagccaggaacacatggaaaggagaaaaaggaagaaaaaaatgtgcaggcagaggcagagaaagagaaaagatgccaaatggtcccttttattgcaagtcaggcctaactggctgttgataatgactattgggtagagcctagaagaaggaatgctaaggtgctaacattcctccagttttgtttaattaaaaaaggagaaactagaaagaggtggtggtgaagcaggagtagggtcattgtgatctttagttgtttcattttgactttgcggtgagatgtgcctgggagcctaagaaaatggggatggggatgttggttaagtcttaggagagttggatgtttccttgctgtccatggtctaccgggccttctgtagataagaaagcgcaggcccagaagagtgtctgtttctgagaataagctggagatgctgcacttctggagctgtcctggatgtagagtttgagtaaatgcctggattttgcaaaatgctcaaacacacatggacatgaacatgcgcatgtgtgcgcacacacgggcgcgcgcgcgcgcacacacacacacacacacacacatacaacttaaaaaataaagttaagttgctttggtagtaaacattttcttaggtgtatatttaaatcctttaggtcttggatgttgagatgaggggagttccaaatccagggaacaggagaggactatgtaatggatagaaacttaggctattgattggcagatggagtctgtttggtccatgagaagtaggtgtgagtgtgattcctggacctaataaatttgcaaaagagacgtttgctaacaccatgaacagtgtttaagccgaggttagggaagataaaaaggttttgtggagcacaaggaacaagaagggttttatccttccctctaggggactgaatatatataatgagaagaatttttaaatttacatttaaaaacaataaaaatttgataatcttgtgactatgatagttgatcatataaaattattatgagaaacacctcaagtctatagttaaaagacaaccaaaagaaacttaaattatcatgagaaaaactttaagtatgtaattagcagacgatcaaaggaaacttaaaatttacacttgtgattatagaagttgtgttaggctaatttatcaggactccattgatcaaaattataaatgaaattcttaaagtctcgatataacagtggaatactaaggggaagaaatatgaaacatttagtcactggaaattgagtttaaataggaagttagaagaatattatctctgtgaaagcttacatctgaacttgtatatcctttatcatgaagtctatgagaaagacaaacctatctgtctttttgataagagatctgagaatcttaactttttaatgagttgactaatgagctaatatggtaatggattacctagatctaaggaaatagaggtctgttttctagctgtcaagatgccatttgtttagctgtcaatgtaataaaaaatctgagaagaataacctatcacttagatgtcatatactaattaaactgacagaggttagtttatagtccacgacctaaacagttttcccaggtccctgtggtctccatcacatttcaggcagaggtagtctgcccatcaggcctagacagtgagaggctttatgctgtggagcaagaatgcaggagcaatgactcaccttatctttggcaatatgtagcacttagttctctgggtgtcatgtatttgtctatagattgggctgagcccttgcaccagtcaaggaaagagaacaatctctcacagtgggcatcataccacaatccaggtagagttacttgtcgctgtgtctgtgtcttcttggagacattatcggggttcactgttaggatttggagatctctgtctgtcatagtaaacttaaacacttgatgttatatttagcagctttctgacaagattgagttctaggatctattgagtatatctgaattagacaatttgggtctggttttaactatttgttctaggttgtatccaggaaacaatgagagtacattataacttgatgacagtaatgacagcagcaaaaacaaggctaaatatatatttaaggcagtgatcattaacagtttcattgttgtgaatctttagaataatattaaaattcttatttacaaaggcagtatagaaatgaatataaaacttttttcttaactgttaagtgtctttggcaactttaagtcaggatgttaccctaaagacagatgtgaagtagggactgcctatatcaaagatgtcagatagtcatgagctagcctacaaccaagatagccctgaagttatagctccagctgtggaggaaaatcatgtgtttgttatatcttagaatggaatgacagttatctgtagaagcatggctatatatcagcaaagacaaacatacaaagatacaaatgggaatattctgtctggtagacaaggcattatgtgaagatctctccctgttgccacaagcagcctctaccactgagctggtcctagtggcatgggctgagcagcacagtctaagtggtggatggtggtatctgaggcaggcacatggagcatctctgctcctctttctcccaccacagctgacttaaagctggtgcagatcagaatgaaaaggaatcagagataaaatctccaaggaagtagaaatttacgactgcctgttggagcaaacagctagtagcaacatttgctacagaatgagttaagtctgaaacaagatctcagatccacagggtcagagagcagagggaaagctagctggatcaaggaaaaaaaacagttgggaggaaaagtgggcaaaagcctgcacaaacaaacaccttccagttttcagaacactggtgagagttttaaacatttttttcaatgtgcagttaagtggccatttagagctattatcttacagatattggggccaaatttaccctgtgaatttggaagccattaagaccatgaaacatcacaatatggagcttggaaatagcaatgaaaccattgcctttaaatgaggataagagttattaaccttatcacttgtggtgtcccgaggataacttaataactaaatatgaaatgagcagccagactagattatcaggtcatcaggagataacttgggggttgagctgcatagctagttcctgagctgtggggtcagtgcccaaggaagaacattttacctaggcctaggattttccagcagtgagagagagaaaagccatttcaagtaaaaaagagtgcttactcaaagttagagctcctaaaatgaggagtcaaccaaaaaggcagtcatgtaggctatgaatacctctgtgtcccaagacactataggcggtagatgcaagctcaatagtggccaggggccatttactctgatgtgtgtgtgtgtgtgtgtgtgtgtgtgtgtgtgtgtgtgtgtccgggatgcttaccaatttatctatgattggatagagagaaatatcaatccaatggctggaatgtccatgaggtggcaggaaatgtgaacctgccaatgtggaaatacaacttactgcagcaaatgatgagttttaaagccagggatatagttttgtggaacacaatttggtgcgatgggtgcctcagcaggcccatgctgaggcatcccttcccccaaaaaaacaagtcataggatgggtctagtatacaatagagttgatttgggaaatggggaggaaagttgggaagggagtatggacagaggaaagagagagagagagggagagagggagagagagagggagagagagagagagagagagagagagagagagagagagagagagagagagagatcagttgtgaacacctagagaccaggggatgtagaagtagagtgggagaaggagaaaagagagataagagggatatagagagatcaaacagtcccttttatagcaagactacctggctttaggtaggtaactgatgtgcagaacctagaaggaatgctaaagagctaacacatttggtagttccttatgcatttccctttccaatgtcatgtactccttgacttccagaaaagatattaacaagtcgtatttacatttgctggaaaataattgtgtatgaacatttaaaatcagaagtcctcctacatttttgtttgcacattcattttcatattcagcaggcatctaaatcaccaaggcttaaaggtgcatagaagaccctgagtgatgttttttgcttgtgaaaaccaagtactgctctgcaagatttccaataactcatgtcagaaatctcaaacctaaatataactgtatttctggagatatacacaacctttggcacctatacacatatgctcattctctctctctctctttctctctctctctctctctctctctctctctctcacacacacacacacacacacacacacacacacacacacacacacaccacagaggcagagacagagagacagagacagagagagagaatggagacgaacaaagacagagaaacagagagaaaaacaaagagaaagacacagagaaagatgtatataaatggttaaaaatcatgaaatctaggtaccattgtgccacatgcctttcttctagcacttaagaggcagaatctttcttagagttcaacgaaaatgaagccaattcatacccaaacttatgggacacaatgaaagcatttctaagagggaaactcatagctctgagtgcctccatgaagaaacgggagagagcacatactagcagcttgaaaacacatctaaaagctctagaaaaaaaggaagcaaattcacccaagaggagtagacggcaggaaataatcaaactcaggggtgaaatcaaccaagtggaaacaagaagaactattcagagaatcaaccaatcgaggagctggttctttgagaaaatcaacaagatagacaaacccttagccagattcactagagggcacagggaaagcattctaattaacaaaatcagaaattaaaagggagacataacaacagatcccgaagaaatccaaaaaaccatcagatccttctacaaaaggctatactcaacaaaactggagaaccttgatgaaatggagaagtttctagacagacaccaggtaccaaagttgaatcaagatcaggttaatgatctagacagccggggatatcccccaaagaaatagaagcagtcattaatagtctcccaaccaaaaaaagcccaggaccagatgggtttagtgcagagttctatcagaccttcaaagaagatctaatcccagttcttcacaaactattccacaaaatagaaacagaaggtactctgcccaattcattctatgaagccacaattactctgatacctaaaccacaaaaagaccccacaaagatagagaacttcagaccaatatcccttatgaatattgatgcaaatatcctcaataaagttcttgctaactgaatccaagaagacatcaaacaatcatccatcctgaccaagtaggtttcatcccagggatgcagggatggttaaatatatgaaaatccatcaacgtaatccagtatataaacaaactcaaagacaaaaaccacatgatcatctcattagatgctgagaaagcatttgacaagatccaacacccattcatgataaaagtcttgtaaagattaggaattcaaggcccatacctaaacatgataaaagcaatctacagcaaaccagtagccaacatcaaagtaaatggtgagaagctggaagcaatcccactaaaatcagggactagacaaggctatccactctctccctacgtattaaacattgtacttgaagtcctagccaaagcaattagacaacaaaaggagatcaaggggatacaaattggaaaggaagaagtcaaaatatcactttttgcagatgatatgatagtatatatatgtgaccctaagaattccaccagagaactcttaagcctgataaacagcttcagtgaagtagctggatataaaattaactcaaacaagtcaatggcctttctctacacaaaggacaaacaggctgagaaagaaattagggaaacaacacccttctcaatagccacaaataatataaaatacctaggcaacactctaactaaggaagtgaaagatctgtatgacaagaacttcatgtctctgaagaaagaaattaaagaagatctcagaagatggaaagatctcccatgctcatggatcggcaggaccaatatagtaaaaatgggtatcttgccaaaagcaatctacagattcaatgcaatccccatcaaaattccaactcaattgttcaatgaattagaaagggcaatcggcagattcatctggaataacaaaaaacctaggatagcaaaaactcttcttcaggataaaagaacctctggtggaatcaccatgccggacctaaagctgtactacagagcaattgtgataaaaactgcatggtactggtatagcgacagacaagtagaccaatggaacagaattgaagacccagagatgaacccacacacctatggtcacttgatctttgacaagggagctaaaaccatccagtggaaaaacgactgcattttcaacaaatggtgctggcacaactggctgttatcatgtagaagattgcgaattgatccattactatctccttgtactaaggtcaaatctaagtggattaaggatctccacataaaaccagagacactgaaacttatagaggagaaagtggggaaaagccttgaagatatgggtacaggggaaaaattcctgaataaaacagcaatggcttgtgctgtaagatcgagaatcgataaatgggacctcataaaattgcaaagcttctgcaaggcaaaagacaccgtcaataagacaaaatgaccaccaacagattgggaaaggatctttatttatcccaaatcggacaggggaataatatccaatatataaaaagaactcaagaaggtagactccataaaatcaaataaccccattaaaaaatggggctcagaactgaacaaagatttctcacccgaggaataccgaatggcagagaagcacctgagaaaatgttcaacatccttaatcatcagggaaatgcaaatcaaaacaaccctgagattcaacctcacaccagtcagaatggctaagatgaaaaattcaggtgacattagatgctggtgtggatgtggagaaagaggaaccctcctccattgttggtgggattgcaagcttgtacaactactctggaaatcagtctggtggttcctcagaaaatttgacatagtactaccggaggatccagcaatacctcttctgggcatatatccagaagatgccccaaccggtaagaaggacacatgctccactatgttcatagcatccttatttataatagccagaagctggaaagaacccagatgcccctcaacagaggaatggatacagaaaatgtggtacatttacacaatggagtactactcagctataaaaaatgaatttatgaaatttctaggcaaatggatggacctggagggcatcatcctgagtgaggtaacccaatcacaaaggaactctcacaatatgtactcactgataagtggatattagcccagaaacttaggatacccaagatgtaagatataatttgctaaacacattaaactcaagagaacgaagaccaaagtgtggtcactttgccccttcttagaataggaaacaaaacaaccatggaaggagttacagagacaaaatttggaagtgtgacgaaaggatgtaccatctagtgattgccatatccagagatccatcccatgatcagcttccaaacgctgacaccattgcatacactagcaagattttgctgacaggacccagatatagttgtctcttgtgagactatgccagggcctagcaaacacagaagtggatgctcacagtcagctattgaatggaccacagggcccccaatggaggaattagaaaaagcacccaaggaactaaagggaactgcaaccctataggtgaaacaacaatatgaactaagcagtaccccggagctcttgtctctagctgcatatgtatcaaaagatggcctagtgattgccatcactgcaaagagaggcccattggacttgcaaactttatatgccccagtacaggggaacgccagggccaaaaagggggagtgggtgggtaggggagtggggggtgggtatggggggactttaggtttagcattggaaatgtaaatgagctaaatacttaataaaaaatggaaaaaaacttttaaaaaagaggctgaatctggttgaactctgagttaaaagcaattctcatctaaaaagtgaggtcccagtccagcaaattctaatgaataaaacactgtttcaaaataaacaaatgaaaataaatttaaaagtacatcatagtaacatttatttaaaaacacgaggaaaaaattcatcactgaatgataaaacagtgcttttattaaacaacaaatattacgttcatcctaagggtttatttttcgtgaacacataggaaattttaaagatacatctaattaagtaaaacctgattaatgcagaatgttgttaaagtagcagtttttaatcgatagtgatttctcctgatggtactataagaatctacagcttttggactttccctagtttgcttacaatttttctaagcactctttctttccttggtatagagatatgaaggtgaatataattcaatattatgtagtcatcattgcacagaaaacaccttgagtatattcctgaccaatttatgtagggttttatgaagaccctcctctttcatactagcaataggacagcttacagctcatggccacctgcttttgtcattagctttacaaaagatttgaatccctgcagcctggcaaacatccatgcatgcgtgattggaaggctgtgcaggctctctaaaacaggctgggggttgggagtgtgattagtcaagtcagtgcagcaggtcctgctcagagaagaggcaggcaaagatgcctgtcacatccaccctaggaatggtcagcaaggcaatgcagcaaacaaggtcagctcccactttgaccccttgtttctttcatagtagattcatagtagaacatgatttgtgcatattaagtattgcaaatttgttgggattagaacatgattctatagatctcaagtctttagctgaaaaatcagatgagaaagctatgagatcattacctggcttcctttgtcctgtcctgtgttgtgttgtctgtggtgcccctccccttcagcggtcaatctgccctgtcacatcagctcagttctcttacagggtgaacattaacatttcaaagtgctgacagtactgtggattattggtgtgtaggacaaagggcagtcaggaagaaaaaagaacatttatatttacagggatgtttcataaaaataatattcctaagcgaatttaagttagattatgccatgccctgaaggatgggaagggattaaagcacttgagggttaacatagagattatcatcagagggaagacacaacagataatggtaggtgccagtttccagatggaaaggatgatcaggtacatatgacttttgacagtataatacctataacacaggaacaaagagtccaaagtggctttaagaaagagtagtggagagtaaattcaggtgtgttaactaccaacatatgaaaacacggggtatctttcacacacacagaaacacacaaacacacaaacacactcacatacacacacctgtgtacagtggtacagaataaaccttttttctgtgatttcataatggaacctaatctgaatgtttacagtcatttaggtctttagatatttgttatttatttttattagtattagtattagtattattttgttatgttcagattaaacaataaactagtgaattagtaagaactttctttggatatataatcaactttttttattttgctttgtcccttgatttgattgaagtttatagatattcaaaacagcatggtgatttttttgttcattttctaccagataaataggaaagggtctctgttgtcttttgtttttgtttgtttgtttgtttgcaggtgattttgtaagtgtattttgtttttcattaaaaaatggtgttggagcagcagcggtcgccatcttggttccgggactcagcagaacttaggaaattagtctgaacaggttagagggtgccccagagaaccggacagcttctgggacgggcagaagcacagagccgctgaggcagcagcctgggcgggccacagacaaccggccaccatccggaccagaggacaggtgtccgcctggcttgggaggcggcctcagcctcagcagcagcggtcgccatcttggttccgggactcagcagaacttaggaaattagtctgaacaggttagagggtgcgccagagaaccggctgaggcagcagcctgggcgggccgcagacaaccggccaccatccggaccagaggacaggtgtccgcctggcttgggaggcggcctcagcctcagcagcagcggtcgccatcttggttccgggactcagcagaacttaggaaattagtctgaacaggttagagggtgtgccagagaaccggacagcttctgggacgggcagaagcacagagccgctgaggcagcagcctgggcgggctgcagacaaccggccaccatccggaccagaggacaggtgtccgcctggcttgggagacggcctcagcctcaggagcagtggtcaccatcttggttccaggactccctggaacttaggattttagtctgcacaggtgagagtctgcaccacagaagctgacagcttctgggaactgccaaagcaacacatcttctgagagaggccctgttttgggccttcttcttcgaccaggaggaggtccaaaaacaagatatctgcgcaccttccctgtaagagagcttgccagcagagagtgctctgagcactgaaactcagaggagagaatctgtctcccaggtctgctgagagatggtaacagaatcaccagaagaacaatctctaaacagagtcaactataactactaactccagagattaccagatggcgaaaggtaaacgtaggaatcctactaacaggaaccaagaccactcaccatcatcagaacccagcactcccacttcgcccagtccagggcaccccaacacacccgaaaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggaagaagtccttacagaaaaagaggaaaaaacatacaaacaggtgatggaaatgaacaaaaccatactagacctaaaaagggaagtagaaacaataaagaaaactcaaagtgaggcaacactggagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatccaggacacaatgagaagaccaaacctacggataataggagtggatgagaatgaagattttcaactcaaaggaccagcaaacatcttcaacaaaattattgaagaaaacttcccaaatataaagaaagagatacctatgaacatacaagaagcctacagaactccaaatagactggaccagaaaagaaattcctcccgacacataataatcagaacaacgaatgcactaaataaagatagaatactaaaagcagtaagggaaaaaggtcaagtaacatacaaaggcaagcctatcagaattacaccagatttttcaccagagactatgaaagccagaagagcctggacagatgttatacagacactaagagaacacaaattccagcccaggctactatacccagccaaactctcaattaccatagatggagaaaccaaagtattccacgacaaaaccaaattctcacattatctctccacgaatccagcccttcaaaggttaataacagaaaaaaaccaatacaagaacgggaacaatgccctagaaaaaacaagaaggtaatccctcaacaaacctaaaagaagacagccacaagaacagaatgccaactttaacaacaaaaataacaggaagcaacaattacttttccttaatatctcttaacatcaatggtctcaactccccaataaaaagacatagactaacaaactggctacacaaacaagacccaacattttgctgtttacaggagacacatctcagagaaaaagatagacactacctcagaataaaaggctggaaaacaattttccaagcaaatggtatgaagaaacaagctggagtagccatcctaatatctgataagattgactttcaacccaaagtcatcaaaaaagacaaggaggggcactttgttctcatcaaaggtaaaatcctccaagaggaactatcaattctgaatatctatgcgccaaatacaagggcagccacattcattaaagaaactttagtaaagctcaaagcacacattgcacctcacagaataatagtgggagacttcaacacaccactttcaccaatggacagatcatggaaacagaaactaaacagggacacactgaaactaacagaagtgatgaaacaaatggatctgacagatatctaaagaacattttatcctaaaacaaaaggatataccttcttctcagcacctcatggtaccttctccaaaattgaccacataataggtcacaaaacaggcctcaacagattcaaaaatattgaaattgtcccatgtatcctatcagatcaccatgcactaaggctgatcttcaataacaaaaaaaataacagaaagccaacactcacgtggaaactgaacaacactcttctcaatgataccttggtcaaggaaggaataaagaaagaaattaaagactttttagagtttaatgaaaatgaacccacaacgtacccaaacttatgggacacaatgaaagcatttctaagagggaaactcatagctctgagtgcctccatgaagaaacgggagagagcacatactagcagcttgaaaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactagagggcacagagacaaaatcctaattaacaaaatcagaactgaaaagggagacataacaacagatcctgaacaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttataaatagtctcccagccaaaaaaagcccaggaccagatggatttagtgcagagttctatcagaccttcaaagaagatctaattccagttctgcacaaactttttcacaagatagaagtagaaagtacctacccaactcatttcacgaagccactattactctgatacctaaaccacagaaagatccaacaaagatagagaacttcagaccaatttctcttatgaatatcgatgcaaaaatcctcaaataaattctcgctaaccgaatccaagaacacattaaagcaatcatccatcctgaccaagtaggttttattccaggaatgcagggatggtttaatatacgaaaatccatcaatgtaatccactatataaacaaactcaaagacaaaaaccacatgatcatctcgttggatgcagaaaaagcatttgacaagatccaacacccattcatgataaaagttctggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcaacaacaaaaggagatcaaggggatagaaattggaaaggaggaagtcaaaatatcactttttgcagatgatatgatagtatatataagtgaccctaaaaattccaccagaaaactcctaaacttgataaacagcttcggtgaagtagctggatataaaattaactcaaacaagtcaatggcctttctctacacaaagaataaacaggctgagaaagaaattagggaaacaacacccttctcaatagtcacaaataatataaaatatctcggcgtgactctaactaaggaagtgaaagatctgtatgataaaaacttcaagtctctgaagaaagaaattaaagaagatctcagaagatggaaagatctcccatgctcatggattggcaggaccaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaactcttctcaaggataaaagaacctctggtggaatcaccatgcctgacctaaagctttactacagagcaattgtggtaaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaaatggtgctggcacaactggttgttatcatgtagaagaatgagaatcaatccatacttatctccttgtactaaggtcaaatctaaatggatcaaagaacttcacataaaaccagagacactgaaacttatagaggagaaagtggggaaaagccttgaagatatgggtacaggggaaaaattcctgaacagaacagcaatggcttgtgctgtaagattgagaattgacaaatgggacctaatgaaactccaaagtttctgcaaggcaaaagacaccgtcaataagacaaaaagaccaccaacagattgggaaaggttctttacctatcctaaatcagataggggactaatatccaacatatataaagaactcaagaaggtggacttcagaaaaacaaataaccccattaaaaaatggggctcagaactgaacaaagaattcttacctgaggaataccgaagcacctgaaaaaatgttcaacatccttaatcatcagggaaatgcaaatcaaaacaaccctgagattccacctcacaccagtcagaatgtctaagatcaaaaattcaggtgacagcagatgctggcaaggattggagaaagaggaacactcctccattgttggtgggattgcaggcttgtacaaccactctggaaatccgtctggcggttcctcagaaaattggacatagtactaccggaggatccagcaatacctctcctgggcatatatccagaagatgccccaactggtaagaaggacacatgctccactatgttcatagcagccttatttataatagccagaagctggaaagaacccagatgcccctcaacagaggaatggatacagaaaatatggtacatctacacaatggagtactactcagctattaaaaagaatgaatttatgaaattcctagccaaatggatggacctggagggcatcatcctgagtgaggtaacacattcacaaaggaactcacacaatatgtactcactgataagtggatattagcccaaaacctaggatacccaagatataagatacaatttcctaaacacatgaaactcaagaaaaatgaagactgaagtgtgaacactatgcccctccttagaagtgggaacaaaacacccttggaaggagttacagagacaaagtttggagctgagatgaaaggatggaccatgtagagactgccttatccagggatccaccccataatcagcatccaaacgctgacaccattgcatacactagcaagattttatcgaaaggacccagatgtagctgtctcttgtgagactatgctggggcctagcaaacacagaagtggatgcccacagtcagctaatggatggattacagggctcccaatggaggagctagagaaagtacccaaggagctaaagggatctgcaaccctataggtggatcaacattatgaactaaccagtattccggagctcttgactctagctgcatatgtatcaaaagatggcctagtcggccatcactggaaagagaggcccattggacacacaaactttatatgccccagaacaggggaatgccagggccaaaaagggggagtgggcgggtaggggagtgggcgggtaggggagtgggggtgggtgggtatgggggacttttggtatagcattggaaatgtaaatgagctaaatacctaataaaaaatggaaagaaaaaaaaaaagaaacctttatatgccccagtacaggggaacgccagggctaaaaagggggagtgggtgggtaggggattgtgggggtgtgtataggggacctttgggatagcattgataatgtaaatgaggaaaatacctaataaaaaaaagagaaaaaaggtgttgtattttatttttattgaaaattaattttaatacaataaattacagttttctcttttttcgtctcctcccagttcctcccaacctcccttttcttctaggtctaatccctttctgtctttcattagaagagcagattcaaatgatagcaactaaacatagcaaaatgtaatataataaaataaaccaaaaacataatgttgtgggtggagaatgcaacctgacagaaggaaaagtaccacagcagcaggcacaagcataagagacacattggttaacacattcaggaatcccacaaaaatactaacctgaatattatagcatatgtacagaggacccaatgcagtctattgtaggctcttgaacagagaggtaagaagaggtatgacctttggcaggaatcatatatgtttgtatgtatgtatgtgtgtgtgtatgtatgtatgtatgtatgcaatttatgtatacatataatttatatatacataaataataatttacataatatgaatattatgtttattacaaataacaatgtaacaatgttatgtataacataatttatatatatttatataatgtaaataatactttgtctatgatttttttctcaaactatttattacataaacatgatttttcaggtttttcctcctggaattttgctgaatgtgattattagcattatgcagtttccggtggcatatttagaacatttttttaacttatagaatcatatcatatttaaattgaaattaattgacttcggcgtttcctactcctatggcctttatagctttcattcttgttgcttacctaagactcctaatactgtactgaataagacaggaagtgtgacctttcttgtctttttcttgattttcatgaaagtgctttgagtttctaatcatttactagaatgctagctctgagtttgattttcattgtcttattatgctgaaatatactctctttaacattatcagtgaccacatttctaaggaaactggacacttgctatcttactagtattcattactatagaaatgtctgcaggtagggttggaatatttagagcaccttcatccttcatttttgaatttgctcttgatcttcttggggaatatacatttaaccataacttttggaggtcatgtttaaacagtcatatcatttatagagaaatatttctgagtacttctccaatcctctagctttcatttagtttccacaactttgtccttaatattgtgtgaccccagtacaggttgttttagatgtcccaactatgactgaataatgacagttccttattcttagtattttaagtagttattcacctttgtgctattcaacacaaactctaataagagtctaatctactcaaagaatcaacagcatgtaactatggaaataaacagaaatatttaaatggaagtttgacaaaacgaccagtcagaaaaataaaattagtatgttctctgctaagacctacagattcctttggcatgtttgatgccagcatttgcagtatcattcctgaattctctcctgaagaacaggcattgatttctaatcaagactgtggttgattactcgagtaagtagtcttaccacagttgcactatgaatgcattggaccttgcaggtcattaatgtagcatgaaaagtttagtgatggataagaaaattattaatttatactctatttagaaaatgcagagagacattttctagcactataaaagacagccagcatggaaagattcctgggtagttaaatgtgtgtttctccatcaaataatatgtatagtgtcttaaataacatggtcttaccatgaagttcacatggggcaattgagaacatgcatgattgtagaaacatgctttctaggattcattgacttattattaattactttagttatatattttccaaatgttagatctcttcccacacttcactccacaagaacccaaccccacacccttcccatcacctctaagagagacttctcctatgcacccacccactcctgcctcacacctctcacatcacccttcaatgaggcaacaatcctccacaaaaccaagagtctcccatcccattgacaccaaataagataatcctcttctacatatgcagctggagccatggaatcacccatctttactctttggttggtggtttaatccctaggaggtataaagcatcttgttagttgacattgttgttcttcccatggggttgcaatccccttcagctcctcagaccttcctctaactcttccatcggggttccccaggcccagtccaatggttgactgtgaggatctgcatctgtcttagggaggttctagaagagtgtctcagaggacagctactgctgtcaacaagcacttcttggcactagcaatagtgtcagggtttggtgtctgctgatgggacggataccaggttgggacagtcactgcatggactttccttcagtctttgctccattctttgtccatgcatttcctttagacaggaacaattctgggttaaagaatttgagatgggtggatggtcctatccctcaactagggaccatgtctatctactagatatgatcttttcgtgttctatctccctagtgttggatattttggctaatgtcatccccattgggtcctaggagcctctcacaaccctggcgtctgggactttctagtggtccccactgtaccctacccctgctacacatttctattcattctcctgatcctctggatttctatcctgtctcttctcataccacaaagctgattctgcctcacctccctttcccaccctcaccaagttccctccatcctctgcctcccatgattattttatttcactttctaaatgcaattgcagcattcacactttggcattccttgttcttaagattcatatgatctgtgagttataccatgggagttctgagattttgggctaatatccatttatcagggagttcaaaccatgtatgccctttggggtctgggttacctcactcaggatgatattttctagtttcatacatttgcttataaatgcataaagtcattgtttttgatagctgagtagtattccactgtgtaaatgtaccatggttttttgtgtacattcttctgttgagggacatcttcgttgttgttgccagtttctggatattacaaataaggatgttataaacataacagtacacatgtactttttatatgttggagcatcttttgcccaatagtgtcctcatgtagaaatttctagtcttctgaataactagaaatcacattggaacgtgatttccaaactggttgtaccagtttccaatccctccaacactgtaggagtatcctgaaacacatggtacagacttatatgtaacttattctctctctctctctctctctctctctctctctctctctctctctctctctctctctctctctctgtctcacacacacacacacacacacacacacacacacacacacacacacacaaacacacacacagaggctacagattccataagataaatcataaacacggaagagggtctcacaaatctaaaaacttcggccttgtgaataccagaaatctcccttacatctgagactgaacaagaaataaaaactcaaggcctgttatcagatccatttatcacaaacaatctccatgaaaattgccacaactaaggatgagggacatctaagttctttctagcatctggctattattattaaggctactatggacatagtggattatgtgttcgtcttatcagttggaacatcttctggatatatgcccaggagaggtatggatggatcctccggtagtagtatgtccaattttctgaggttcttatatcattgagaagagtttttgctatcctaggttttttgttattccagatgaatttgcagattgccctttctaatttgttgaagaattgagttggaattttgatggggattgcattgaatctgtagattgctttcagcaagatagccatttttattatattgatcctgccaatccatgagcatgggagatttttccatcttcggagatcttccttgattttgtccttcagagacttgaagttcttatcatatggatctttcacttccttagtttgagttacaccaaggtattttatattatttgggactactgtgaagggtgttgttcccctaatttcttcctcagcctttttaggatgtttatcggtgggatttcatgtccagaatctgggggaagatcagagattgttgagattgcatgtaatgagcatatgcttttcattctctagagtaggtgatggttctggctgtgagtggttgagagtgtttggtagttagaatctggtagtagaaggtcctcagggaagtggtctgaacactcgaaagctagaggaatttacaataactattcctagatctgtcatcaagaattaacagataactaagtactattattacctggactgcatttagggattattggtgctatttactctgtgccactcaatgcaggtattctattttccacagccaatacgaagaaataaaggaagtgttggaaagatgtgtctcacactcaaaccaaaaaattttctacagaaaagaagattaacataagaacttagatagactttcccttacagcatatggaaataaatatttagaaactagattttagggaatgatggtcaaattaagatattaaaaattgatgattattgtataaatgtgaaaaatctcttttcatacaaatatacaaaaggattctacattgtaacaagttatataaaatcttaaaacaagcttataatctatgttatagatgtgttatcatactctgtaacctgaacatatgcctatattagatacatcacaactatacatggtcatatttagtctgagaaatgagccacagtaaatcagagcaaggaaagagaatctgccagtgacaaataggactaagtgacttaaactttctaatgattaaaaaaaatatatatggcatgtttgtcttaatgaggtttaatggaaaaatgagtccaacctatctattttccaacacaagactttctgagaacataggatatttttctgctacttattattatttatacaaaaggctagctagagccaagtaatcagaaaatgtacattagagtaaaataaaacagaactaaattatgggtaagaaacttctaattctgcagttttctgaagttttgactcttatgaaaaactacttttgcttggtggatgttataataccttattggtattagaagtattgtctctccacatattaaattgtcttcatattaaaataactgtgggccttgtctaggtagtttacagttagttctcatcaaacttaaaataacaatggaaggggagctaaggaagctgaaatggaaggtcagagtgtgagtgtgggcaggagagtacatcaaagaattactggaagtactttatcactcagagaatcagagtcattagtgacaaacaagaccttattgtggaataaaggtgtgataggacatggcccaggaaacagaggtttgtttccttgcatctttaaaacttctcttcccttccctcacatttgatgaacatggtagggctgaatcaaactgatcatccttgctcagagttaatggccaaggaattttgaatgggttctattgtacagaaatatcagcaagagtctttgtatcaaagtattctggtttgaaactgtgactatagttatagcaattcactcatcacatagattttttaattcactacctaggcaacccctttgcaggaaataaataaaccttacttagaggggaatatgattgcccacctctggctcaggattaatgttctgcacctataatttatattcggtgtggtaaggaaagaccctcacaactatatgcaagtggagtttggctactttgctttgagttcttagaaagtcacaggtgcacaccctaccatgagctatctcagatttgcagattacacacacaaacacagacacacacacacacaaacacacacacacactagttcatatttaaactgccttattggctcttgggctgggctcttctatgccttccttggctagtgtgctcttaccttttctccttgctcaatacctctaactcttccctcaacacagttgcttggttacctttactcctacctagataaacacctctaaatctgccctcaacttagttgtccaactgcttttactcctatctcaacatctctaaggacccttgatcctgagaaggtttgaagccccagagtaaggggatggtagaggggtgggatgggagacggtgtgtgggtgggtgggtgaataaccttatagaggcacagaagagtaaagggagggaggttgtggattggagagcttgtggagtggttacctggaagtggggtatcatttgagatgtaaacaaatggaatgattaattaaaaaaaagaaacagaaaaaaagttgaaatgaaaagtggtgttgttataatcccaagccattggctgaatatcagtttcttctgtctctggtccagacctctttctctttttagtagcttatagtctagccctttccaaagcctggagtcagctcagagctggactcctactaggaacttgattgacaaagccctgtgttcagggatgtgtgttaactatcatggcctctgattccttcagtctttgcctgaaaataaaaacattaaggaccaatcagaagaaagatctgatatttagaaatgaaaagcaaaagtgtgctataacaaaggagatctctttcagaactactgtttcatcttgttcttccttcttcttgtatatagcaacaaatgtgtgtgtgtgtgagtgtgtgtgtgtgtgtgtgtgtgtgtgtgtgtgtgtgtgtgtgtgtgttgaaacactttgaaatatctgctcaactgttctaaagaagtatcgggtgatcacaaaaaagtcacaaaaatgagattataatgccaagtaatcaaaacctaagacaatgtaagaaaatgtaatcctttattaacaaatatattctccacagatctgagggaaaaaaattaaatttgtgaactcatgtcttcataatcttcagtcattctttttttccattccactttgatatactgattttttttcatgaaatatttctcccttccctcacatttgatgaacatggtagggctgaatcaaaatgatcatccttgctcagagttaatggccacatcaatattggttagtgtttgctgaacctcacaaggaacagtcatatcaccctgtccgttcagcaagtgcctcttggcaaaggcaacaatgtcagtttgggtgtctggagacagggtagatccccaggtgaggcagtcctcagatggcccatccttcagtctcttctccatttgttgcttctgttcatgtgcattattttgtgtctgtgttaccttacacaggattatattttctagttccatccacttgcctgtgaattccatgaagacattgtttttaatagctgagtagtactctggtgtgtaaatataccacattatatgtatccattcttgggttgagggacaaccaggttgtttccaccttttagctttataaattattctgctgtaagcacggaggatcatgtgtccttgatatatgttggggcattttttgtgtgtgtatatgctcagtagctgtgactacaggtagaactatttccaaatttctgaggaaccaccagactgatttccagagtgtttgtacaacttgcaaccacacaagcaatgcaggagtgtgaattcattgctggacatttgtttttgacaatgagccaccagtgtggctttaaattctgtcattaatgagaaaggcttgcagttctgcttcatctgctagaaaggcaattcacttaagccttcagtgtctgacaagaacaggacaccttgtgctcctcacacaccttcacataagaaatgaagaattttgtcagggacagctttctgctagcatttgagacttcctagtagcttaagtcataatgtttcctaaattatctcccctgtgacacaaagacttctgaaagcaaagaatgataatatttcattctcttttttgtgaccctattaccatcagttgtcttagttcatacttctttcttttcctccattcatagaatttattgcagttggtacacggtttaaaattcaccaacacaccaatagtactaaattaaaccacattatacagtattctccctcgggaaacaaagcatactatgattaccaaagctagatgtcagtctaagatttagaaaaaggaagaatgtgaaactaagaaaaagaaaaagcactcatgatgacaacaaaaaaaatccaaaaagcctgtttttcaacattgactgtctcctctaaattaataaatattattttgacataaactgtattaaaaacaaactagaaactcttcaagtaactaaagataatgctccaaggacattttcacagctacttttgtttgcttatttgcttgtttaaaatgacattacagccaaaattcacatacatttgatgaaatatttccaaagcagtccagaaacacacaatggggttttccattcagtatcttaagagcaaaaataggctatgtttacagtagttaaggcaatcaaattttaaacaaaagcaattaaaaaaggaaaaggaaaaaacaaccgtttttccatgctattcccatagatcttatttgtaagtgcaagacaggaaaacagtgtgcaaaatgcttctgccctgcacactggccatcagaatcacacatggggcttcagcctcttctgctgatacatagtctactaacccactttcccatgtccatcacggcagatcaattctttcagcctgggcctttgttttcagtctataaaatcttttcaggacttagtggacagtgagaaagaaaggaaataggggaaaaaaaagaaaagggaagtaaaaaggagggagagagaaagagtgaactatgacttattgttaaatgatgcattagttattctaaaaacactcagttggttacatgtgaacatctaaatcctgagttggcatgggttctatgcaatttcaagtctggtatgaatgcacactgcacatgcaattttttttgttgtagttttttttaattaattttttattaggtattttcctcatttacatttccaaaactatccaaaatttccccaatacacttccacccccactcctctacccactagagtgaggagaataatgaagccactagagcatgaagccactagagctgcttaacacagttctaccaaagctatgtagatttctacaatccttgttctatccccaacttctgggatttggtctctgtgtgctgcattactggggacattctgcatgatggatcgttttatgtcttttcctgtgtaaaaatttctgagtctttttaggaaaatccttaaattaactttctctggccactatttgaatgtatcctttatgccccgctgatcattaagcacacataaacacatagctccataatgcctttactctaggagttttcttgtgatatataactgtgaatgaacttaaacagtatacttaatgcagagtagagatcaactctgacttgccaggagaataggttacagatttaagatctcttttttatctgcttagaggtctctataaatgtacttaaaatagggagtctgacagtatacattcctgaatgagtaaaactcaataaataaaataaattaaatacattctgacatggtctctgagttcacctatgcatcagtcatgtgtctataagatgtgctctacttggtggcatggactacatctggaacttactagtaatctttctaattactttgttcagagatatctgtgtacttttaagtgctcagagtttcttgtgttcaggacattgttcttgttgtgtatctttatttcaagggtatatatttcaagaagcttctctgatactgtggatcaattaactgactttttctcttcttatactaaggtagcaatttgattaaatatattaaatttatttttatatttgaacataaatttcaattaatattttatcacatttaatcaaattttacataagacactgtaacattaactgtgaaactggaagaaacactaaaaaatgtattaaaagcaatagtgtaatatatgatggcaaaggagacagatactcttctcaatgttactatctttgagtattcacacaggtgattgcttacatacccattagctcttcaaaatgtaccatagctatcatagcttgcaagaaggctctaccctataaaaagtactttcaaccaagaagtcctgtgggattgtcattttaattaattttttttaatttgatttattctctgaatatttgtacatttatacattggttctttatcatatctactctcctttcatatctagtctccccttagaacattttcctccgaatccatgccctccttttaaagtaaatacatcatttatgtataaataccaattactccaaatagtgttatccttctatatttgtggtattaaaacctagaataaagctaccaacatgttcaatctggtagtgaaatagaagagaatggaacagagtttatttttgaagaaaaatgcaaatccttgatagtaaatccttagtgtaatttagagtattcccaaagcctaccaggtatacttgcctaaaaaatggttctgatttagagtttttcttaaaacctcctataatccaattcagataaatactttaggagtatgatttgctgcacaggttttagttactatctcatgtagtcagttgacaaccatagttaacaacaactctgtgtttgcttgtttgatcataactcgctttctttgttcatttttataaagcaagctgttctttccctattcctcatccacaattgtccaattaaagctgatggagatgcctataatcagagccatgatagcatagaagattgtgagaaagttcacagtacaagatatgaggacctttttagaagtcaacatttccttcacctaatagagttattgtagatatactgtgtgaaacatttgatcttgaaatgatatacatacaaaagtctacctatcaccttacatagtacttttagtagcacaaaaatgtcaaatttcaagcatattcaataacatttgtgtgattggaatgctagtcatttgtctgtttctttgagattaaagcaacattttaagtggttaaatgtacattattaggtcccaagtgttgatatattctatgaatttgattctctgtgagtctgagattaggagttttataatttatttttccctagcatatcacaattttctaaatatacctgattccactattacaaggagacagtttgttctgttcaaattttatcccgaaattctcagatactttaacaactttcacacccaacaaaaaggaaacagagaccaagtgacatacttagttcaatgacatatttacttaaacgtatgtattttagacgtttgtgacatcttttgaaagttgcttagattagtacttccacatgagtacttattagcacagactgttctagactgtcttcttacacatttgtatgtctttgacgtatggattttaggataggatctcctgatagttattaaacaggcttgacaaaaataccaagaagaaaaaaagaaaagatgaaacagaaaagctaaaagagcctatgacgacaaattgtagcattttcagaaaaatataaatctcagagagatacattaggtaaagcctgaatatgtcactcctgtagagtctagtggacaaaaatatttaagggctagcttttcaaaaatctctttaggcaggcaattagttgagcaagttccagactgtattggcaaatccttaaagagtgatggtgaggatcaaatcaacagtgtggacagctctgagacaagaggccgcaagacaactgagttctgtccagaccagataggagacccttacaaatgtgtgttgctgtgcctttagaatacctcagttatctacctctctgaagctataaggaacaagactcagtatgttgagatggggagaattgccatataagctgaattcctatttggtttctggattttctaggagatttccaatgatcttctattcaaaatggctaaaaagtttagctcagaaaataagaaccttgagacctgtcacattatcatacttgtcaatttcttccatgtctgccagctacttcatattgttgatgtaacatgcctaccagtcattgacacataaaaataacctgaatgagagcaaggacacactgattaataccctcttattttttgtatgtcatgaattttgttaagcttaggaaattccacaactgtaaacttcacttagtagccagcaaattaaaagtcaataagaactattatgtctaaaatagcttgagtcagggctgaccagcaggcagagctttgaacagctgcatatgagctcattgtgtgctttgtggttatggcacttgtaagctgacactgagaaatatttagggatttatttttcaactccagaaccttatatgtccctgagcaattagtctcagtgtgttccttcaacaaactgtccctatctgactgaaatacgtgttcagctggtttgtgagcaacttctggacccaaataggacatacttccttttgttcatggtggaaatttctgaaaatgacaatttagatacagcaatgggatttctgttttgtgacctctaagtatattgaagatactggaagttagcattgatatgagaagagatgaagtgagtatattctttttcctgtataaataagctaactttgtgtgaaaaaagaggaatgaaatgactctataatgctagtcattgtgaatgtagaaaatttctcactaggtattttgtggagaaggtgagagctgactgaaattttgaatattctaaaaatttagataagataataggaaaatgcataaattgaaaattattctttatagcatgtagcaaacataaggagaatagcaactttcactgtgtcctattatttttgatggaaagttgacaaaatcactcaatttcacatcagtgagtgttgtggttaatcactaggcaataggctttttagctctctatgatcaactagagtgtccaggtccactatcctccaaatcaatcatatagatcccacttttcctcatgtgcacttgtctatttcttttcacaaaatgtttcctaaatcctgtgttggcaaatattaccaggaaaatggattgtatggcagtctataaagtttgtaacacttttggtgagtgtaaatttaggagaaatttgtatatgtggtggggtgttctcatatctcaatgtgtattagaagtcacaaagcaacttgaacaattcagtttttatttctttacaatgtatacaacctggggaccaaatttttggcaacagcctcagttgaatgcaaatttactctctatattatcttcctgccccagtgcactagtcggtacctcacctagaatctccactgagctctacagaagcatcactagcaggggctagcctccagccaggcttcactctaaatctgttttccaaaactgtacataactcactgttgtaggatatttgatcacattatgaacacagatattgtgtaatttactgaaaaaaaaaacactcttttggattatggtgtcactcaacccttagcaaacacccttaatccccttagtgtgcaccaaatacaggatctgactttatttgacttaaacaacatgggaaatcctacttagcctcagccatgatctttcacttttcttttggttttaataccagcttaccatgaaaccctgtcaatatgttttatatatttttaccactttcactgaaacatttctaaagacctagctagggcaaggagtatggaaagacacaaagaaaggaaagccagaattagggcacttgtgatatgaaaatttctttgctgagattaattttgccacacttcataaactttagggcttcagtttacttagccagtataggaagactcacaaaaacagaaagacttcaacccagagtgctaactaggtggaattctgtaaggttatttttggagaaaatcaggtgcagtttggtgctaagttaaacacaaggaccccgcccacccatggtcttttgttcaatattatacaatttaaaacatatgcaacactaatgaacttgagttttactgtaagggaagactgcgggtttgatatggccattaaagccgcacatttaaaagccctgctggtctttcaagatttctttgcagactcaactcaataggaaagcttacaatgctgaatttccctctttagagttttctatgccaggataaaatatatacatgctacatatataattattaaaagaaatgcattaccataatagttattactatacataaatggtatataatgatatgcattaaatgcaggttataggacattttattttaaacaattccaaaacatataatttactgcaatgcacatatatgaagaaggaaaactaaatgggttccacaagtttctgtgcgagtatgttgccacagaccttctgggtccctggtctgtgaggaacaggatttcttaggcagatgggcaaaggggtcggatgaaaatgacaatcagccacacacaagagaggtgttgaatctgaatgtaattttccagtcgagcatcagacttttataatacagaataaattgcagaacaaggcacattgaatttttccaggtgcaaaaggagtgacttcaaaaggaaccagataaatgtataacactagagattagcacagatgcaaggggagtgactacaaagggaatttgtagggaccagataaatgtttacattagagattagcactttctgccaggcaagagttttacacttagagttaatagccccagggtagttaactcttgacacacctcaagaataatgtagtgtcactgaccccaaaattctctaggcctcgttaattcttatctatatctgaagactatccattttcagtatagtatactaatttgctcttggcatggaatgtagtctgtaatacgaatttctatctcagtgagaattttagtctctttctgtaaacagctgagtaaaatggcaagtgctttattagttactgaatgggttaagctccttgctgctatctggaatctaagaacactgtgaaaaggctttagctatgttagaatacaatcttaaaaggcatttactataaggtaatgattaatagagtcacgtgaatctatacaagagactaatgtgggaatggaaaattaattttatggtttatatagattagggagaaaatgccaggcccccgggaagggagtttccttgaaactctttgcttcatgaaccagcttcccagcttttgctttgtcaagctgactccaccagagtgccgtgacagtatgtgtgttcatcacttcagtgcaggtcaagcatgttcattttcacccatatactcaatcatatgccaaaaaatgtgtcctgtttcaaatccagcatctacatattctgtgaaaggaaagaagcacataatatactatactgaagtaatgtttatttcatatgaacaataagctgcagaatttagtcagaactattaatctaaattttttaaaagtgttctaaaaatgttatgaggtaccagtatataagaaattcataggtaatatctaatacttttcaagaacacagcaaatgagatggataaaacagaataacacatcagggaatacagtagagacacctgacatacactttgtctatagtcattgtatatccatgggtgataattagcccgtgttccatttgtgacaatgttttttttttttttttttttttccattttttattaggtatttagctcatttacatttccaatgctacaccaaaagtcccccttacccacccacccccactcccctacccacccactccccccctttggccctggcattcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttggatactttctctagctcctccattgggagccctgtgatccatccattagctgactgtgagcatccacttctgtgtttgctaggccccggcatagtctcacaagagacagctacatctgggtcctttcgataaagtcttgctagtatatgcaatggtgtcagcgtttggatgctgattatggggtggatccctggatatggcagtctctacatggtccatcctttcatctcagctccaaactttgtttctgtaactccttcaatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagacggatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatgggaattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagcgcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttagggtaaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaagttggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacagtgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctctggtccggaaggtggccggctgtccccggcccacacagggtgctgcctcagcgcctctgtgcttctgcctgttccagaagctgtcaggttctctggcgcaccctctcacctgttcagactaatttcctaagtttggcgggtctcggaccaagatggcgaccgctgctgctgtggcttaggccgcctccccagccggacgggcacctgtcctaagttcggccgtgacaatgtttgagaatcattgttgcaaatactacaccatatggtataatattctgtactccatcactagccacacaacaaacctattttgttgacattgtcaaattgtgaaacgtattcccgagagtatgagaataccaagaatgaataaactaggttttgtagcccccatatatacatggacataatgaaaaattatcagaccaattagctatctttagatatccatgaaaaaatccagtacagggattgagtcacgtttttaagttaattggcagacaatggggcttcaatgcaatcctcaaaccatccaaacagtttctaatactctaccttgatctatccaacctgtgagtaaggaaccattgatgaaaacagttcctctattgaacacaaagttgctgagctggcaagggaaggtaccaaggcctcacactattactgaggctatgaagtgctcaaaaaaggaatctatcatgacggcacaccaaaagacccaacaaacagctgaaaagagtcagatgcagatatttgcacccaaccaatggaaagaagcagataacccctattgttgaatttaggaaggctaaaagaagctgaggagaagggcaatcctatagaaggactagcagtctcaatctggactcccacgatttctcatacactggactaccaaaaagacaacatacaccagctaatatgcagcccccaacacatatacagtagaggactttcgggtctgtgttcattcaaagacggtgcacctaactctcaagagactggaggcctcagggagtttaaaggccaggtgtggtgggaggtagaggcaaccaagtggagacaaggggtgcagaggaggtgtgggacatggagaagtcagagtggttgggggtggggacagggaatggaaaatggagtgtaaacaataaattaattttctttaaaaaaaaagaaaaaagtttgactaaaaatattgctgagctggtgtctctgtagaacctttacccccaacattacagcatctttgtaatggcaagctaatattcatgttatcaaaacagtaaggtaaaaacaaatacagccataaccccattatcttcaatgttgtattacatgtaaaatatgtgagagtactgatggcacaaaacttatcagagtaactatttaataatgggtttgaattaagaacaagtccacaagatttagccaaactgttactccttggctgacacagagcttaaaactagatgttccctggacctaagagaaaagaaaataatcatctaaaaaataaaaatagaaaaaataaaagtgatgaaatgtctccctaacatattctttctgctatacacataaactagtaccattttcagctttgagcagagaagttttctgcagtatatgggaagaaatgcagaaatcctcagccagatgctgaatagagatgagagactttggaacaaacagccttaaatatgatgtatccattaattccctcctctcaaagctcaaggaaccccacataagttcaggtagagacataacaattgaagagtaacttatacctggtggcactgaggaaatcagttttctccaacacagtgacactaggcaaatcagtcaagtcactccaggataagcctcatgcttaagagtaattggtcaatataaaatggacttttcagtgttttgggtttgtttgtttatttgttttagttttttgaggtatgggtgagttgtaaattgattatagtttggtgggactttttgacatgtttttattttcttgctttagagggttttgttgttttaatagattttggtggggtttgttttttggaaaaaaaataaacttgcttggttgttaggaaaattgaattggaaggacattggggaaggaagaagatcataaaagagaaaaaatggaaaaatgacaaaacatatcaaaaccaaaataacaaaagaaaaatgatcatatggcatacattaattgattttagttttctcatttaaaattaaagagatgttttcatccctgtatgctccccttttactcaaatactaaaactatatatagcatataaaatgtattatttttatataatactgaattgatttcatctccctatttatactcattcatacattttttttgttcctagggtaaaaggttgttattacatttctataacagatgattcatatctaaatatgtactagtttgattttggactaatatttagcctgttgttaagcataagaggaaatatactacattatgtaactgcttctcacctgaaattagtatatttttcagggccgaataaggctacaatactagtgaaagcctaggaggacttaaggaaatagagcaggggatttgtctgaagcatcagccttaattcataatgatcaatcacatttcatcagcattcagtaagtccagagctctctagttttgtaagaccatttgggattggcatggtgtagattgatttgaggcagtttgtagtccatagccaattcctggacggtatctaagagttgagtgaaaatctgctgtgacagataaaaactactacacaaagaaagttaaggtactcaggggaaatcctttatcttttgggtatatgtgatacttttaggtccattggatagtagtttggtttgtagaagtattcccaagattagagaaatcagagaaaaggagggagagagagagagagagagagagagagagagagagagagagagagagagagagagagagagagagagaagtctcagagagacaacccagtctcagaggaaaagacaataagcatagaaatttaagatgttggttgacagaaatatttatctggaatatctatgaaatattatgctactataactaaaatattccatttgactattcttttatttaaagtaacttgctttgtgttgactgtacatagcatttatacacatcttgagaaaactaagaacagtatgagatgagtagcagtaatccctataggaaatagtattattttttgctgatattttcctgggctgtattattttgatccccttttttaagcatcaagtggcaaaagtgatgcaggagagatattaggaaatttctcaatgagcttgcttgtgttgaaagagtggaaagccaaacaccaacttcagaaccataaattaataaactacagcatcatgaaacagtatttcaacattagccatagctaaaaggcactttattcctgcaaaactgaaacaagtgtcctatagaggaaccagagaaaacagggaacaaagagagctcccatacatatgccagctccagtagtgggcagcagtcaataaagtagcaaggtaagaaagaaagactgctatctcttaatatcaatggtctcaactccccaataaaaagacatagactaacagactggctacacaaacaggtcccataattctgctgcttacaggaaacccatctcatggaaaaagacagacactacctcagagtgaaaggctggaaaacaattttccaagcaaatggtctgaagaaacaagctggagtagccattttaatatcggataaaattgacttccaacccaaagttatcaaaaaagacaaggagggacacttcatactcatcaaaggtaaaatcctccaagaggaactcacaattctgaatatctacgctccaaatgcaagggcagccacattcattaaagacactttagtaaagctcaaagcacacgttgcacctcacacaataatagtgggagacttcaacacaccactttcatcaatggacagatcgtggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaacagatacaaaaatactgaaattgtcccatgtatcctatcagaccaccatggcctaagactgatcttcaaaaacaacataaataatggaaagccaacattcacggggaaactgaacaacactcttctcaatgataccttggtcaaggaaggaatgaagaaagaaattaaagacttttttgagtttaatgaaaatgaagccacaacgtacccaaacctatgggaaatgcaaatcaaaacaacactgagattccacctcagaccagtcagaatggctaagatcgaaaattcaggtgacagcagatgctggcgtggatgtggagaaagaggaacactcctccattgttggtgggattgcaggcttgtacaaccactctggaaatcagtctggcggttcctcaggaaattggacatagtactaccggaggatccagcaatacctctcctgggcatatatctagaagatgccccaactggtaagaaggacacatgctccactatgttcatagcagccttatttataatagccagaagctggaaagaacccagatgcccctcaacagaggaatggatacagaaaatgtggtacatctacacaatggagtactactcagctattaaaaagaatgaatttatgaaattcctagccaaatggatggacctggagggcatcatcctgagtgagctaacacattcacaaaggaacttacacaatatgtactcactgataagtggatattagccccaaacctaggatacccaagatataaggtacaatttgctaaacacatgaaactcaagaagaatgaagactgaagtgtggacactatgcccctccttagaattgggaacaaaacacccatggaaggagttacagagacaaagtttggagctgaaatgaaaggatggaccatgtagagactgccatatccagggacccaccccataatcagcatccaaacgctgacaccattgcatacactagtaagattttattgaaaggacccagatgtagctgtctcttgtgagactatgccggggcctagcaaacacagaagtgaatgctcacagtcagctaatggatggatcacagggctcccaatggaggagctagagaaagtagccaaggagctaaagggatctgcaaccctataggtggaacaacattatgaactaaccagtaccccggagctcttgactctagctgcatatgtatcaaaagatggcctagccggccatcactggaaagagaggcacattggacttgcaaactttatatgccccagtacaggggaacgccggggccaaaaaggtggagtgggtgggtaggagagtgggggtgggtgggtatgggggacttttgaaatagcattggaaatgtaaatgagctaaatacctaattaaaaaaaatacctaattaaaaaagaaaaaaaaataaagaaagactgcagctcctatggtaagctgagaagagacaagagatgtctagaataaactgcaggaaggaggtgagaaaaactctagttactgagaacacaccgaggaacagctcagaagttcagaatgcatgatagcttagacatgtccatggtaacactaatggtacatggggagacacctgatgagcttcagtttatcatgttttcctataactggaaaagaataatggaaacatgataatacaaacaaatgagtgacgatgaaaatgtgtccaaggaacacaagacacaaatttgtagctatcaagacaaaagatatccagataacttcttgatcttatatcagcatcctgttataggttaacaaactgtgagcaagcaacactattttattttataaattatttttaccatttatcttaaaaagtaatcttataaaaaccttaaagaatcataaatctgaactcatataaaaagtcatttctactttaattcttcagcattcacatattgtcaacattgttttgttaaatcataaacagaagctgaggtcaaaaatcaccccaagaaatcaattatcagagaactgaaatagctgaaggggttagcaaccccatagaaagaatatcaatatcaaccaaccagacccccctccagagcacccagggataaaccaccaaccgaacagtacatatgtagcacaggatagtcttgtcggtcatcaatgagaggagaggcccttggtcatgtgaaggctgaatgagccagggtaggggaatgccaggactggcaggcaggagtggatgggtgggtgagggaacaccctcatagaagcagagtgagaggggatgggatagggggtgtccagggtataggaaactgggaaagcagataacatttgaaatgggactaaagaaaatatccaaaaaacatatacatcatacatgtgtttcataatattggcttatacagttgtcaaaatccatttttattaactctcctctttcaaatatcttatcgtcattctgttgtaaataactattagtactgattttatcaatacttaatgcatctatattattgaaccctgctgttctgtccattgttttaatctcttttaatctccctataccacgtgctgtgaatgaatagacaaagcatgttgaacaggaaagatggtattcctcaatctagatgatcagaaattccctcacaggaaaccagagccacaaagtaataatacaatgggaaatttgctgaggccctataacatacaaagtctatatacaccagtgccatggagcacagtaacagtagcatacctgttaggaagaaaagcctgaccagataaggggatttctcaaatgggtcaggtgttattctgagactagctctaatgttcctgtgatggtatattcagactgaagatctaaaagcattcctcaagtgcagaatttgacaaaaaaacaaatagtatcaacgctattttgacaaaactcctggttttgtatatatcttaattttatttaaagcaaaggaatgctatatttgaaggctcatgcatatccatcgatttgaaaaaaaacaatacaaacaataaaagggaaaggaaggaggatgttagaaagaaacgaaaggaagaaggaaagaattgaaaggaatggaaggaatttataagggaacccatctgagaggaagagtggactattgggaataaggaaggggattgtaggtaactgaaaaacgatgcatagtatgaatgagatcactggaaatttgaactttatgatttgttcaaagactttaaaaattgaaaaattaataagactaaactaaattcatctcgttcaccattctaatttagaatgtgtagttgtgaaaaatcattgaccaatatgaacacagagaaaagatggttatatcatctaaaagtcctagggtacatattatcactgaagaatgtcatggctgaaaactgcagagaagcactgaagtgatgaagatggagctaaactacttactaacttgctctctatggcttactaaactatcttttattaattagaggaccacaggccaaaatgaaggcactatttagagaggcaagcagaaatgtttcagggcaatatatttatggtgtcatgactggaatagcataatttctcagtgtatcacttgcactatgcagggatcctgcttcactagcaagtaatccatttaacagccattctatggtgaggtatacaaaaacagattaaaagaacaacttgagagataaattttctttcctgagttcactgtttaacatcactctagattctataatatccaaatctaaacaaaatgcacaattacctgcctctttaatgaattttatgtaatataatgactataatgtgtaaaaccatgtatatgttagcattcacatcagcaacctaagatccaaattaaattagagattttcaagggctaatttacaaacaaaatagcattaataatttttgctgaaaattgtgtcatggtgctgcctgtgccctggaccacccactgccagaccctacttgccattggggttggaggtgaggtgacaaagaatcaaggcacagattcgagaagcagttaaaaaacaccccagcaagctcatcctatccttgctgcaagctctatcaataccttcgacccatttcccattggtcccaagaaagtgtcccttctaatcagaagttcctgattggctgtcaatgtctgttacagcaatccttgttctctcaggcagtcctaagttagatcctcctgcaggagatgactttggggttgtgtggccaccataacctatgcagaagtggttgcactgttccatatatatttccatccttttggttttactttttgatagcatagtggaagctggggtaatattgctttgacattgttaactccacttcagaggattcccagcataatggattgtgtctgtcttaggttgtcctgtcttccaggaacttatgcatcattgaccaccagcctcaaagagatatcacactggaggcactacatagtggtctcatggatgtctgccaaccaagctttggtcatttcattagggggttgcaatctgaatttttgagagcgttcagcaccttgagggtcaccttatttatggtgcactgcctggagatatgctgcctgagacacttaaacaaaattattattggtatgacaactcccccctcatagtgtatgtgactaatgacgaggggtcaaaaagcctcttaatattgtcccacactgttgccaagattcctacatctagagatagcacagatactctggttatattgaggttagctatgttctcccttaatagcacagatagttaaggaatttgtctgaccaggtaccttcaagatattgaggcatctgttgtcaggcttcagtggtgttatgcacctgattaagggattaggcagattggtgaaacctggggtataaatagagtcctatcccaaccaagggccaaccgttctgctagtatgtcaatctgttgttgtaaaatgtggatgccttgttaaagatgttcatttagtacatcctgtccctgtagtacctcacctaacttagagacaaaagcattaacagtctctgctgtagttgctgtctgggtcaaagcaagaatagctgttgttacactggcaatgccttcagtgaaggccacagtggtggcagctgtaaaaccaaaatcccccttttttcctagtgtaggggttgtgattctgggccatctgggccagtgagtgttagcttgaaagttggtgatatttgccaaaggcatccaaatgctactccccatcagaatatccattgttgaatactgttcagaggttaatcaggagacatttttcattaaaacagttaaggctatctctgacaatggaggtattggtggctagaaagaagatgggacatcagacacagactggagtggatttccatccaacctggattccgatggtcacattcatgcagtcaccccagtgcacaatttctccaacagtttcatatggaaatacaccacactaaagaggcagtcaccatttagaagagtaagggggcataaatcaagacaattagaagggccacataaatccctattgatcataatgtggtcataacagcatctaatgtgatcccaattaaaacaaaaagtaatattggaagcatcatgtgagttaaactttgacatgccaagtgtaaggttagaagacaattttgggtattccctagctaattttatgcctagtgcagtctggcagtgctctcaagagatagaaacttcgaaaaaaaagtggtcatttgaggtgtcctaggacactgaggcagaggtggatgtgatatttttcaggatttttaatcagtaagggaatgtgaagttccatgactgacatgggttatattactgtgaacatcccacatgaccatattgtgtagttgaatacaaggaccgatgaatgagacattggtggtaaagcagagaatttgcacagagggccaggtgccttctaatcactgtgtagtagtgacaagtccaagacaggcaaacacattgaaagagaataaacagggtaagttagggagttaacagccataggcaaataatggggtctagggggaacatggccaccaaatccaagagctgatcagtcttcccaggctaaagaaaaattaataataccagcattatgatatgtttctgcattcggtcttcttctgccttcttaaataccatctggtctgtggctggacaaacatatcttgagggtaccatattgtcacacttgcattctggggggaacaaaaacataactttgcccccttgacattaaaagagtgggtcgttgtctttgaaaggctattgagtcccttcatctaaccaatgggagtgctccattgcaaaaacacccaatgtttgtaagcaaggcccattcctttctcttcaaaatggagaaagttcacattgaacataacctccaccaatgatagatatggatttttttttttttagggttctgtggaggtgactcgtgcaagtgcttccttcaaagatttagtctttttaagattgcttggccgtgatgattataggctatcccaaagaagtgaatgatcctccataagaatatgaaggtgataaatagctgatatgagaaagcagccccattgtcagtcttgagtgcccaaggcactcccattacaaatattactaattttatggccttattagcatgagaagtcttttcacctgccatggccacagtgtatatgaaggcagagtaagtatctatcatcacatgtatttacctaaaattaccaaaggctggataattggtgatatccatttgccagattgcattggtgagtagacatgtatggttaactcctgatctgccaggggcccacaattttgcaagaagtaggcacattccagaggaacttgcaagatatatatagcgttacataagcaattctaacaagagcttatgtaaattgtgagaggaaagtttaaattgctggtttaaattaatattagggcttgttctagcaattctatgcatacagcccattttgccataatcctggtaagacccctcatgggaatacagaatcatggcctgaagggggttccttggatcatgcctttctagtgctgataaagaaagaagcatcataactttctatagaaggttgctagcttaggatgttagtttaaccctgatagaggggctaataggcccctccaagagagtaaagacatgcctcatatccttgtccaaaatagataggaaaggttttagccagttatacttccacacaattgttatagttctaaaagggggtaggattttttatcatagtggataaagccaggggcttaatcttgtcagaattagaaaagctctggaaggcatatggaagcattctctgaatcttttcaggagcaatcttcaagttgaattttcccaagttaagcaacaattgagagaatatctgtactgactagttttgtgtgaacttgacacagctggaattatcacagagaaaggagtttcagttgaggaaacgcctccatgagatataactgtaaggtattttctcaattagtaatcaagggggaaaggccccttgtgagtgggaccatctctgggttgagttctataagagttctataagtcttgagttctataagagagcaggctgagaaagccaggggaagcaagccagtaaagaacatcactccatggtctctgcatcagctcctgcattctgagctgtttgagtttcagtcctgacttcgttggtgataaacagcagtatggaattgtaagctgaataaactttttcctccccaacttgcttcttggtcatgatgtttgtgcaggaatacgaacccttactaagacaatacccttttaagatctggtaggctaaggtgtgcaagcataatatcatccatgtaatggactacaaagacatctctggggactcctgtatggctttagcctgacaaattgctaggctattttcacacctgtggtagaactgctcactgatatattttacctggttaattcatattaggctctcatctattctgaagaaaaatggcatctattctgggaaaccagagggatttggataaaagcaatccttaatatctaagttcatggtacttgggtggaatagcacaagtgagaggcaggcccacttgagtgttcatcactttttccatatgttcattaacagctctcagttcctggagaagcctatatttccctcatttcttctgaatgaaaaaatatgtattattattattattattattattattatacaaagtattatgtatgctgctcaaggattccaaatgactcaaagataattgttccaagactagttccttgaaaacaaaaagcctaggttccaaaatgggccactgatccacccagatgtcagcttcatactgccaggccaaaggtataaggtcaggtaccttgatgtcaattggtgttgggtggacagtcaccattatatttggggggaaatccctgactttgtgacctgtgcagtccagttggtcatgttgcataatattgtcaaaaaaaaaaaacaaaaaacaaaaacaaatacaacaacaacaacaacaacaacaacaacaacaacaacaacaaaaaaaaaaaaaccctaggaagtatggcatccctgtcttctagaatatttttttctcaaagtttgtggggaacatcagccacaacaggtgtcaaagattcctgattgctgttcaagtactgccaacagacaggtcaggtagtcattttggtggcttggtagcttccaaattctgtattgaagggaccagaacagaatctccaatgggggaaccttattgcttaatttttacatttatagtgacatctgcccaggtgtaaagtaaccctttaacgggtataccatctaaatgtacagccatcatcaggatgtttagaaatagcaagttccaaaggactacaggccaagcagtgctcactcttactggcatggctgaggcgtgaactttttgaagtttaaattgtcttcctgcttttgggagagctttagccagtgtaaatttaagctttgacaagggtcagtttgctctcatgttcaataccatactaagcataggaaggacagtattttgtgattgtgttacctcactcaggatgatatcctctagttccacccatttgcctaagaatctcataaatttattggtttaatagctgaatagtactccattgtgtaaatgtaccacattttctgtatcctttcctctgttgaggaaacatctgggttctttccagcttctggctattataaataatgctgctatgaacatagtggagtatgtgtccttattaaatgttggaacatcttctgggtatattcccaggagaggttttgctgttcatcattgggaagagaggctcttggtcttgcaaatattatatgccccagtactgggcaataccagggccaagaagtagaaatgggtgggttggggagtggtgggaggagggtatagggcacttttgggatagtatcttaaatgtaaatgaaaaaatatctaataataataaaaagaacatctttttaaagaagatggtattaataagttctatgcaaaaaaaaacaagagaaatattttttatcaagtttaattgattaatgctttgaagctcacaatattatctggagaaaccaatctgattacaaaatttttattcttcgggaatggacggtggaaaattaatgtatttctgttaagtcaaaaaccaatggagtaggcacaatcaattttaaatgacaaggactacttttcagaggtggaagttggtcactttgctgaataaggcaaatggtaactccaggttttagaatatgattttttcaatacaatggtctattatattgacaggaggtagaacagtgtgatcatccacgggatgaaaaagatacgcatgataaccttctcttctcacatattcagctgcatagatacaaatacaggttcaccagagtagaatgcaagttgatcaatattttctgagtctatgcacttatttcatccttcctcctgctgggtcacttttgagtagatcttcatcatcacgcagactacatactttattcatcccagcaaaattagtatcaaacaaatctttccatgttcttgagcactaaagctgctatggtgagaaagcacttgtccatctttctctttgacctggtggatcaggctgagactcagaaatgttgggcattttccccacacactaccaacacccaagcatgaactagaggaattgtttctcatccttctcacttttaccctacacaaatgctttactttttatttctgatgggtttattatatggaccttgatataggcattctcatgtatacaacatgcatatcatatcacctctctgtacacacaaacacactcagtgattattttactccccacaactattcttcctgatttgacattgactactcctgaattcttattttaaatatttaatcctatgtttttcccttaaacatggggattatctgtgtcaataaaggactgcaagaaacaggagatctaacagccctttttccatttttgaaaatccattccatgaaaaaaatctgtgtgataaattggcctcatccagtaaccttaagcttataaacgcttacatcaacagggtgtgttgacaataactttgctatttctaggatcattgacatttatcactatgaacatccactgctgccatttgacttatatctgtgcaatccctgtgtattatgccagtctctgtgaattcaaatgtggatcagtttttgttgtattttgaaatatttgcttcccaggtgttttccattctcattggatattattacttttctgtctccttttctacaaaatttcctgatgactcaaggcaggtattaaatggagatattgtattaaggattgagtggtccaagttttctaactctctgtatacagttgtgggcccatgtattcatcctcatctaccacaggagttagcgtatctgaaaatagccaagcaactctttcatcaatgaatatagaagaatgtcattaggagtcattttacagttgtttacttggtatagtaataacatttgattcttccatagatttatcatgtctaaaatccatatatgcacagttaacaatattagaaattattgatgacatgagagaaaacttattcacagagttggatcctaaggggagaaacttaggatggctatgttagtagagttttctcttattttatatctcatttctacaatgggatctcaattatagtaattaatatacatgaatgattataaaaaacttaaagtggtgacaaaatagtatcactattttcataatcatttttttaattgttgaggaaaacttatgatctgatgactgaggcaaatgttttattttgacagtaaattttacaaactattaagagatgcttttagttacctacaaataatctattggataatgtataatttattctcttctattatgctttaagtagcagataatattcttactctttttacctaaagcattctagacaaaaagtgaattgaccatttatttttgtccttgaaaaaatctactaaaatactaaaatttattaaaatattgacacagaataaactaatctatatagtacaatgtacttttataatgattacagatatgagtaaaaattctcattagtagcatatacactagcattcagtgcttcacctagagtaaaaaaatattaccagtcttttagtattgctgtgaagacttgcatcctaaaagatcttgtaaatctcaagccacaatcagcatacatcttgttttatgagtgtattttttcagttaattatttaacattgagaaacattctaaagcctaaacgtatcctcccatttatgtaaaatgaactactgtataaatgtacagatctcacaattgaatagtgttactgataaagtgtttttcttcttgtgatcttgaggtgtgaactcttaactctgcccaagaacttaggacgtgctcctcgcctatttaataagaagattacacagacacacagaggcatgacaagacagtaataatttagaaaaaggtgcttgctttctttcttgcttccttccttgctttcagctttccttattagtttcttttgtgtttcttatattcactttttattgtttcatatcattgcatattcattggctatatttttaaatctagatattttgtgaatatcttttctttcaggagaaatgcaatatttcttaaactagatgttatttatctttcttgccacagaggaaaactatatatttcattttcttaatgtattgccctgaggacaatatctagtaagtgttcaaagatctgaaatcagcttgtgtcccttcaagtctaacatttaaaaaagtaccaagaatgtcaggtgttttcttccatatatattaatgaaatcactcttccatacatgacattatttgttgtgtgtttcgctcatggctgcatttttttaataaaaataatagtttcatgtatttatataggtatctgtatagtcactttcaccacattttacatcattattactctttgttctacttaaaccctatattctaaatcctcttactactgtattttctttttgaaagaattttcgacaatttttaaaaattattctacaataatactaaatttatctaatttctatatttcaattctgtatattctgcactcctctttaaaagtcactaactcctcattaaaaattattgttacatatgaacacacataaaacacgtatacatttgattatgcacacaactctacagttggtggaacctaggatatagaactaataaactaggcatgctaatgtcccagactgcagcagtttagactctgagggttaacaattgttactggagtaaaggcctcatgaattaaagctgaatacaacacaagattaagctacatgtggcaaaaacatgtttttaaaaggcatgtgggtaggttaaacatttaattaaatactgacagcaaggaaaaaaagagaaatctcagtaaatactctactatgcactacacctatgaggagcatgaaaacatattctacagttctgtttctgaagaaatctaattcgcaaaaaaattatgatttgttttttattatactgttttgttctattttctttatcctggcctattctcatgagcattaagaattctgctaaatctctccatttcttgatcctcttccccacctttttaaacattgaaaaaatgattaatttttaggaaacatgcataaatacaccatgaaattagattcttattatttactcactgtgatgccgtacaaaatattgtgtaaaagctaagtttaatccgtatttcataaagaaaactattccaggcagtccagtgactaagtaaggtaagacagtgacaaggacatagctagattggtctaccatttaactcaagcacaatctgggaagcagcacaagttcaaggacaaccttaaaaatatgataaaaactttgattttttttcttgatttctttcttttttatttattctctttgcactcccattactgcttctcttccataatcactcctccatgccccctcactttctcttttaagagggtggagtccttcacttggtatccacccacatcagcacatcaagtttatgccagtctaggcacatctactctgccttaggccagacaagataacccagatagtagaacatatcccccacaggaaacagcttttgggatagccaccaatccagttgttgaggacccacatgacaacctatctgcacatctgctacacattatcagaggggaggggaaatgctaggtccagcccatgtatgttctttggttgttggttcagtctctgagagctacagtgttcatgttagatgatgccactatctggttaataaaaaaatttccattgacttttacttgtttttaagtagacttctcttgtagatacctcaaaacacctccatatcctgtaataatatattgcactagccttaagcttgacagttttttatatttatatgatttaacaaggggttatacttaggtattcatgtgaaaaatggccaatatatgaactgagccatacctatagctcatttgatttttttttacattttattaatatatgtataaagtcataaatttctgtccttataagctgtttgactagtttcattatcaaaccatcatgtaaaattgtaggggaaaaataatttaaaatgcatgtttatcacagtttgcattagttattcaaatatttcatttattaaccaaggaattaatcctgaatgctcatgagtagaacctaaagagcttggaaggggacagtgttctgctgattcgtgagttctgatttcacactcagacctgatctacatctacttgtttgactagaagactgtaagtaaaggcataacacagatagcaggatgtgttcattggtttaatgttgacaacaatccataaaaataataatactagaaaaatttaaaaataaatggataattatttcattagtattttggggagagtactcactgcaatttgtacaaccacatgcactatattactcagggttctctataggaaccttgagcttttagattgcagcctgagaaaaattttacattgtatcaatatcaaaggaacatataattactcctatatagttcaagttttctcttcctttcattttatcatgttttgtattattcaaagtttataccaaagatatatatagtcttcatgttagatgatgccactagctagttaataaaaaactttccattggcttttacttgtttttaagtagacttcccttgtagatacctcaaaagacctccaaatcctgtaatagtatactgcacacacacacacacacacacacacacacacacacacacacacatatatataccttgtatatcatgatgataacaacctcaacacaccaacctagcatttttattttttaacgttgaattaatcatgttgtctcacatatgctaagccaccacactttaatgagtgtatttgtgcaaccacttcctaatctgtcctagagtcaccatccgtattacttttcatcaaaagtcaagctaacatttatatgtttgtatgctttaaactccctgcgtttaattattgctttctatatgtacattggttttgggtcctttatttttacattagtatcctactgcagttgcatagatccccatgtacatctggctttccctcccttgtacctacccactgtaaatattttcacatgtaacaggaactctatgtaccctcctcttcattgcttgcatgtttccttacttgattttaatcacctcccgtttggtaactaatttttctttgttctgtttaatagccatgtcaaaaaatcaatattttctacatctttgacattttcctgttcatctattcttcccatgtttatgttcataatttttctccctctcttctgcaagttgatataaatattccagaaatgttaaagtgaagaaaatctgtgtgtgtgtgtatacctatacatatacatatatatattcatctatatgacattatgacatgggggaatcttagtccttaatttgtttttaggaaaaaataagactcagcactgatatctcaagaagaataatacaggaaatttgagaactgattgttttttcaaaatatctaattcaaaggtcaattatcagaatgctatcctttagactatttcatctctactactaaaaaatcttgttaatatggctttattcaaaactcaaactttattcactctaaaagaataaactaaacaatattccagataacagcatcctctaagatacttttctttctttttttgtaaactgtcatccaggattttatgcctgtttgacaattgtggagaaagttttgatatagtcatcattatcatgtcatttctagaccccattatgagtgagaggcatgatatcactatctagtaaaggtgaaacatcaattaattttataattctagtaatagcaaggagagtagcaggattcggctctaatcaaacagttagcttttaccttgctgtgaggattgtttttatatataatccacagataaagcatatgcctagtaattggagctcaataatccattcattttctggtgttgttggaagattttccagtaataggagaatttaaagagggattacaagataggataaacagagaaagagctactgaagtattggaatttaattgtcacagtatgtcagtttagatttagttcataaaaaaaaatgaaatgataggaaagccaatttctgcactaaggaaattgtggaagtctctgaagacttgcaagaagttcacaagggcatccatggaaagtcaagtaaaggaaaccaagtctacctgatatgggcaattatccatttttcataatacttttctttataaacgtaaactgtctaataggatataccttcctaattaaagttcaatatatcaccatgagttcactacttcaactttgaacatttgggaattgtacatataatagtcatataaaggagtaatcttcagaaggagaggtctatagatgtgccttaacttgttgggcatctaactagggaagaaagtgataatggtagtcccaatgaccattaggaataagtgttctcttgaactatgtgtagactttgcaagaactctcttcacaggtacaataatcactccacacccctggagttattgaactgtataaacctccctagatataagctgaggggtgatgtttaaattacaaacatagtgtaatgaacagcatagcagcagaggccagatacatcatttcagacattagtggaatcaattcagatactgaaggagaggataattgaagaaatcaaaatgacataaatggaaagattctgggagatttagtaaagttgatgtatacaaacaatgttagtgtctcatgtgcattctgatatatagaacattaatatatgtgttaaagaccaactgtgacactgaagggcaaactgaggaaaactgcaagtggaaatggcagtggttggtggtaagagcagttgaaggatgttggtccggataccaacaggagctgctgcctgtggcaggcagtgataagatagggtgtgaggggagaagtacaaacatacacacagacaaacacacagaaggttgaaacaagagctgaacttcaacaatttactttttccctcaacagctatttagatcacttaagaaaaaggttttatttattttttattaggtattttcctcatttacatttccaatgctatcccaaaaggtccccatgccctcccccccccactcccctacctacacactcccactttttggcactgggattccccagtactggggcatataaagtttgcttgtccaatgggcctctctttccagtgatggccgactaggccatcttttgatacatatgcagctagagtcaagagccccggggtactggttagttcataatgttgttccatgtataaggttgtagatccctttagctccttgggtactttctctaacttctccattgggggccctgtgatacatccaatagctgactgtgagcatccaataatctctttgctaggccccagcatagtctcacaagagacagatattttctattggaaagaaaattacctcccatccaggagttgcacatgttctagagacagtcactagcaaaatatactttccaaatatacattaaaatatttacacaaatggaaattacgttatatttttcaatgttttatatgaaacctatatctaattaaacaattggaatctatcttcatttgcaaaatcccattttgaccttaaaccagtaattatttagtcattgattaacaaagtttgagcagtcaaaagtctcaagtcaaaagtagcaagttactgtctgtgcttggataacaaccatctgtacttactcagaaacatttcatgtcttacatcttatttttgaagttcagatcagctaagctggctaatcatctgttctctgttcttatactcaataaaaatgtttgttctttattataagcttagtcttttcctggtacacttagaaaacctgctaccttatccctagatcacaagatcagtgaattcacgccaaaattattgcacatgtttagtttgaacaaattacatgcttgtaatgtatgttgaattctcactgtgtgcctttttgtaactcaatttttgccattctatcaggaatggtcacattttttttaaaaaaatctaacttaaaactttctctcaactgtcctaacttcctacctttatactttttaccctaactacacttttatagaattaacctaatccccctaaatattttaaatcaagctaatttcataaaattagaagaagtaaaaatttccataaaatcgctagttcatcttactacctttatgccaagtactttcatcttcatgttgaactgcaagaaacttgtgcaaccagggaggttatcacccaagaaataataacatacagttttaaatattatggttcttccaatgtccacttacaccaaggcaaataaatgaccatggcaaagagaatgagaaatatgggaaagcaccactgtatccacaagcaatcaggggacaaatctccgaagttgtgccataccagagctcacccaatgcagctgaatagaaagttgggtatcatgaggaagctcgttttcacactgtaattgttcctgcttaatgcctgccatatgtacatgaaacaattgatgataatatatcagaaatacccgtgctcaaaatcacctggcttattgaactttgtttctcattaaatgtgaacacactgaattgtgctttgaacaagtgacaatggaatttcaaaaggtatcatgtttatagtctcggcagctctccaattaatttcagaataattgattggaaatctttattagttattttattcgttgacatttcatatgataacccccttcctggggacagctccacaattatccatcaaaactcccctttcccctctctcctttgccatctcagaaagcccactttctgctctaacatatccctacactgggtatcaatcctccacagaagataggcctattcttctgttgatgtcaaataagatcatctgtgtgttggaatggtgtcctgcttctggcacaggagccctcatgtgggtccctgtactacacagaggccagtgacagcaagttcacactctgtaggactgcagactcagaagacttgagaacactttaggggcccatggggtaggctgtagcctggtgctgaaggaaaaaccatggaaatggaagaaggacctctggttagttctccaagtgatgataatatcataagcttagtcacaatggtggcttggcttggaggtgacctggtcgagagagcagggagccctcatgtgggagattagatagggctctttagaggaagatctactcaattttcacctccatacgtcctgataagaaaagactgtctatatttaaaatatatttaggtatacttaattagcagcaatatactcataggttcttttttttttttttaatccatgccttcactaggctggatgatttgataatttctgagtaaggaatgctttccttcttggttattaactctaattgtagaactattggttaccagaagagcattaatacaactactataccctcagatttattgctggtcattgtggttcataggaatcacaaatggaaagggttgtttcttgcttcccttttttcaaatctcatatggtgttatctggtaacatagatttatttctcagggaggtacttttcatgtcagtaagaagagtacatcttaggacaaggtttctccccaacccacccattcccctctgctgaggtatcaagttttcacaggaccatgtgcctctactccctttgttgccagacaagaccatcctctgctacataaggagctggagccatgggttgtttcatgtgtattctcaggttggtggtttagtccctgggagctctgagtgatctggatagttgttattgtagttcttccagtggggttgcaaagtccttcagctcctttaatctcttctctaactccgccatctggatcccggtactcagatatatgattggctctgggcatctgcatctgtatttgtcaggctctgacagagcctcttaagagacagctatatcaggcagaagttagaaagctgttcttggcatcagcaatagtgtttggttttactgtctgtatatgggatggatctccatgtcagtagtctctggatggcctttccttcaatccctgctcaatattttagagaagagcaattctggattaaaatttggagatgagtaggtggccccatccctcaaccagaagacttgcctaacctctggatccagtctctacaggttctctatccccttttatgggtattgtgtcagttgacattgttgtcatatatctaacagtatttaattctaaataacgacttatttgcatttttatctatgtgagccctgttcctatataaactaaacaatggtgctagcaaatgttccctaaggacatgaatattttcagtaccaaatgaatgaggtaacacttaattttccataaccttgaacaattacttaagaaatatgacaatgctcataacactacactacacatttaaacatatgctatactgaaatgtcacaaattttgaaaacagaatatgtgtgaagttttccatattcacatttgtttttctgtttcccaaaatgtacattcaggccttgactgagaaaatcaggtgctatgtcctctaataggtacaatgaacatatgacctagatcaacttccttttttctgctagttgtaacagatattatatgcttctatatgcaaagtttaggtattagaaattctgtctttcctcttgtctgatagaaacaataaccccctacctccaaaataataaaaatgtagtgttttctctatgatttcatgttatctggagtcctacagtaattatattctgaatttaactacatgaataatttcctgtgatcaagttatatattatttggtgtaaagagtagaattttggcttcataaagtattacacacaaacacaaatgtatttacctgtatagaattagagaatggcgtaattgtgggcaaatagaaaattaagaagagacctaaaggacaggatatataatacactaggttaaggaatttgagaaggcagaattgtaagtttgctgtaattattttatgataaaaatattaaactgtatgttgctgtaacatgaaattgtaataattaattatagcaaaattaaaattactattccagtaaaaaaaaatcaattcatgtacccagtggcaatagcaatattttaacttactgtaatttattggaacatgttaaatctatataaaatacaaagtaatacctgagggtccttgcatctgtctgtgaaatgccaacttacaaataaacatgcacatatatattcacaataaaaaagaaaagtagatatatcaatggtaccgtttttggcagaatagtccattttacctaggaatgtgccttttgtctgattacaattaatagtttgaagccctacaaatacagggcatgtaaaatatgtcaatagactggtattgttgctaataatatctcatcccagtgataagtttgagctaaaatactgaagtagaggcatagaacaaaattgattcggttaaatctctgtagccttcaatatagctatcttaggatatttctttccttcactgtttcatcttgaatgaaacattcaaagtttgaataggaaaaatgtcagagcaatcaataaatttgcaaatttgtaagactttaagcatactttctgtggttaaaaacaataaacaattcattgcggagaggaagcctttagtgtcttattactatagcactgttctcctgatacgcacatagtgggaatcataatttatgttgagagctttagggtgttaaaattggacttccatataacccatgctgtcatataaaacacattaaaattagtttatgaattttatattagttgaacactgttttctttatgttatttattcaagacctcttaaggttaattgtaattcctacatatcattcatgaaatatagttcagcagtaatattagtatagaccttaatgctttctttactctatgtaagtacatatactttaatttatgtttaattaatgtattatatgacaactatatttcaaagcaaaaaaatatataaaaataaatggagaaacttcaggaagtactgtagtatagattacaactatgaagattttgaaaacatattctacgaacagttccgtgttctgaagaaatttaatttgcaacactcatgatttgttttgtgttgttttgttttatctttatcctaaaatattctcatgagcactcatagtcttactaaatgtctccatttcttgattatcttcccgaccctttctgaacattgcagcaaatgaataatttttaggaatatgtataaatataccatgaaaatgggtttttgttatttactcacaatgctgcagtacaaattattgtgtaaaagctaatttttattcttatttcatgaaaaagactattcaaagcagtccacactagggttaaacagggaaaatgacatagttagtttggtctattgtttgattcaactggagcctgggaatcagcacaaattcagggccaggcttcaaaacatgaggagatctttgttttttttcttgatttatttcctttttatattattatctttgcattctcatcaatgttcctcttccagaatatctcctcaatgtctccttgctttctcctctaagaagttggaatcctcccttttgtatcctctcacctcagcacgtcaagtctatgccagaataggcatatacactcccactaaggtaagacaagataacccagcgagtaaaacatatcccacacaggaaacatcttttgggatagcctccacactagttgttcagtacctacatgacaacttatctgaacatctgctacatataatcagatgggaggagaaaagctgagttggaaacatgtatgttcttggctagtggatcagtctctgagagccccagagttcatgttaaatgatgctgttggtcattctgtggagttcctatcccctcaatgcaccacaatccttcttccaactcttccataatagttcccaagttccatccactatttagctataggtatcagcatctgtcagagtcagcttcagtgtggccaacattgctagacactagtctgcaagcataagggagtatcattaatagtgctagtgattagtgcttacaggtgagatgtatctctcactgggtgggatattgcttggccattttctcattctcaattccagtcccatgactgtatttctactagacagcataaattttggattgacagttttgtgggtgggtttgtatccctatcagtcaactgtttctggcctgactacagaaggtgagtactttaggttgcatatcctctatgttagaagtcatagcaaaggtcatccccattgattcttgggcaactcccctatcttaggtatcaatatgcccccctacctctccaacactaccaggaacatatttccattcattctcctgatcatctggccatctttcctgtatatctcctcacttgaccctgacactccctcccttcattttcatcttgattccctctcctaaaccatttactccatctatctgcttcctgtgtgcattttattccctatctaagtgacaatcgcacatccttacttaggtctttttcttgtttagcttctttgtgtctgtgcactgtagcatgggtttcttatttttttatagttaatatcccctgacaagtgagtacatatatccatgtccctttgagtctcagttacctcactcatcaggtaatattgatttcaaagtatcccataaatttgtgtgtaatgagccttcattttttttttttggaaaggcagaaggcatggtctttattatgcatcacggcatcagtatatattttgttcagtgtctgtgtatcagaaaacctacgtggcaatgagttcttcattctgtgctcatcaaaagccaaagtgaatattaagaaacctggactctggtgtgatcgtttgtcctcagcatcccgtgtcccactctcccttacagggttcaaggcggaggccccaggaggaagagaggtgactggtggtagacagggcctgtgtggctcgccagcctcatagagcctcctgctcctagactggcagggaactgtgggcagttgccagcctgtttggttgggagggtggaagcttactactggactgcgtcgtgaaggagactgttcataggaatctttaagtccagatctggctgcccgtctagaatacccatgttctcggcagctctattttcctttgcatctggcaagtaggctcaagtcctcacttttactgtgaatgaaactcggggctgggattgccatccctcagggcccgaggttgatgaagggaaagtctgtaacaggatgcatttctgcatcctgctacagaaaatgtcccacccaaactgacagccttctgggactggaagttgggagcaaagcctggttttcgtgggtggcagggaccagcaggggtgggcagcacccgcagctctcagccgaagcagtgaacaattcatactaactgaaaaatatttccctgacgtacttcagcacgccttcctcctccttctcctcctccgggcttctgctacagggagagtctgaaccttctggtccccggggagggctgaggcctggatcaagggagctgatcctgctgtcttcttcctcactgctgctccttgttttggtaaaatagtatgtagatgacttttaggaacatctgaatcataattccctttagtttcattatttctctgttaatttttgtttaggtgactgctgagaaccagcctcaaccgttttggggttctcaagaataggaagattggatccataccaaatcagaatctcaagcacgatggcactgacttggtgttctaaagctcctgtctaagaaagcttttccgggtcattattttcttcaaaccaattaattttcctgacattcttatctaactatacaaccaaatcacacaaggtacataaaagtcacaattcagtgcctgaaaaaaccaaagcaagttatacattaacatttgactcccagaaaagccatcaaaccaaagctcttctgggcatgagcatgtgcttacagcattagcattaacattatacaagtcaaaataatattaatattttagcttatcttaaattagcaaaatctctttattaatctcatccaaatatgtatttcaacagtgacctgtccagcaggtccagttatttgagggtctcgaggggaccttctcctaagaaccaaatggggggattgagagagatgaggaacaagtgcaagaacgacatggaaatattctgagtggcattaaagtcccactgtattagcaaggttcaaggtttaaatgcacaagcaaaaggggaagtacttctcagcagaagggatggggcagcagaaatttttcttttggcaactacatggggaagcaggaacttggtggtatcagggtatatcttgaggtcaggacatccagcactgacttagggctggaacaatctgtggttgttctcagagcagtgggtcagttgcccgcttttgacccccttttcttctcgggggagaggcccaaatcagagaataggacaatagtgttgtcttaatagctcccaacatctcccctgttttaatatttttataaaggcatattgtataataaatttgtagccacgtttttaatgaccacctaaacatctgtttgctcactgggtgattctctaaaaccacgaaggacacaaggacaagtcatctatgaggcttgaattaatggttccagtctgttgggtataacctgggctagccaagggatttaggaatgaagcaagctccgtgggtagagatagaggtctgatccccagtgtgcaatgttagaggccatgtacaggattgactctcaggcccacagatttttactcagagtaaccctgacctgctccagtgccttttttcctgggggaaggagcctagagcactcaacattcatgcaatcagacatgcctctcagagacagtctaacagcttccaaactaatctctgtgtagtacttagtctcacaactctcacaggcgacagcttcaggctccaatttttctatgtgtctagcctgggatgactgtttagtttccaatgtggcgaaaatgtatattaccatgtcggaagcacagactacagcaatctataaatgattcgtggcatgagactgatggccaaatttagggagaggggaatgatcttacttaagcattttatggaaatcgagtctctttcctgagatgagggtgatgaagcagcatctaaatctgactcttctccagtaacctgcttgttatcgccaacgtctagccaatggtaatgaactgaaacagatgcacttgaaatagataaatcaatttgagatttaacaaattgggtcaatttctgaaatgcccaaggaccaaaggaaatcaataataggagtaccaataggggccccaaaggggagggcaacaaggtcgaaagccagggggagattgaaaaccaattttgataccatagctcttgttctctttctctttttcttttttctaaactggcagtaaccttggcaatgctatctttaactaatcgacacaagggctgcgattctggtccaggtcccagttccagcagcacccaggccaagaaggaccacaagggtcacctttgagataggctctctttagtggcgggatggcaaggaggcacctcaatcccaaaacttcagtaagtcatctgactcatgaaaactaaattttggaaaaagctgaaataagacacaataatctctattatttataaaatcttgtataataatgtactgtataaggcccttggaacatgcaaaataggtatcattttgggcaagaagataagaaaacccatttttatttttttttttccattttttattaggtatttagctcatttacatttccaatgctataccaacagtcccccatacccacccacccccactcccctacccacccactccccctttttggccctggcgttcccctgtactggggcatataaagtttgcgtgtccaatgggcctctctttccagtgatggccgactaggccatcttttgatacatatgcagctagagtcaagagctccggggtactggttagttcctaatgttccacctatagggttgcagagctggttggcatctgaaaacagggtaaaatttccaaataaggctatgccctcataaaaggctggggaagcagaaaagcacatccaacaatcttcatattctgttgcattatcactttgtgtcttatccaacaaggctaaagcagaatcattcaatatagaccacagtaaatcagtgcaagaggggggaccccacagggaaagtggactgaaatagggtcgttgcatgccctggggcagaaacagggggcaggtacctggaagtctgggattgtttggggatttagggtgatgtaattgagaattaggtcctatggatgctttatgattgttaggggtggttttaagaagctgaaccttaaaggtcaggccattatcatacttatcttgatccaatctgaggcaagagggtgagaacttttccaagcctctaagttcttccccatagattcacaggaagactttaaccacaaagggttgaacagttccagtattgttttctttgtctgaccatgttagcagtctggagctttgtaaagtgtcctgtgtttgacctatgccttttaaatgagtggcagtgggctgtaagggacaggctgtgggccaatgtgttgaggaaattactttcacatctgccctggtatccaggagcccttaaaactgtttgccctctagaaacaaagtcagcatgcgccgtgaatcagttattttccgtacccagtagacttctgaggatcccggggaggatggttcttgctcctctttcatataaggaaaatagccgaatagtgggagtggtagggcttgggctatgtgctctccagccctaagggaagtggtccctgtgtgactgtgactaagatttttaactctccatggttgtcggtatcaaccactgtaggagtcaatgttaggccttgtaaaactctggacactcagccgatgacaagaaacttcttttggggagggggtccaagttcacttgtttcgatgaccacagttccctcctcaggagttataatccaggtagtggaggaacacaggtccaatcctttgttccctgccgtggccctacacaatctcccgtgggggttagggggttgtctacagttgtcatcaggggagacgtgccctgcaggggggccctctggccatttcagtggaccgcagggagtgggtggctgttgatatcaaacttagatctgcaatctttgcccaatggaggcctctcttgtacttagggcaaagaccgtgggggggggttgttgggtaacaggcatagttgagagtggggttctctgtctttgtgtagggcatcctctagcaaaatatccaggttggttgcatctgtagcaagtttttttctcctttatttatttgtttctgagagggacctttgcgaccagtttgaggatttttagagatgggaccttgaaggttccccatgagggctttttgtagactctgaatctctagactgacgtcttgtagctccttttgaagcactagaacatctttaagattggtgatctgagtctgaagttctcttttagtttgaagtaatcgctgaatggatgaaggggccagcaatacaggccgaggattaggctgaggattagggggagaggggggcaaataaggaggagggtggaaattgaagggctcgatggtaagataggcacggagcctggaaccatagtggtctcgttcatatttaaaggcttcctcatccaattctgtctctgaggcaggattgaggggttcatctgacaactccttatacaaaatggggtaaattctttttggtctaacagggggttgagcagtagccgcttttctagaatctaatctaatttggggagaaagagggagaggcagggagtccttagggactggggcatctataatcgatgatggccaaaactgaagattcaccagtggcttagtttcgcttttgtgattcagcaattgggagttttctaaaaattcttcagtaaggactaggaggcaatgtcttctccaccctcttctgcctgtttaaggagatctctgacgattccccaatagctaaaaaaggactcagggatatcttctccttgttttattaaagtattgatatctttgcctatttcagggccattcaatgccagccatggacatctctcacccaccaaacaaacaaaaaaaattattaaatcctttttcttaactcttatccctctctcctaaaaagaccccttcatctcttgaatataaactgtctctttggacagaacattccccatggtgaatgggacaacaactgaatgcacaggcttacctctcgatgtccacaacactaaagcgaagtggctgggaactgtctcactgtctgtgtggtacttctctaatccattttccggaggttggccgtacctcgtgccccccttctggtgccacttgacccgtccagcaggtccagttattcgagggtctcgaggagacattctcctaagaacaacatggggggataaagagagatgaagaccaaatgcaagaatgacagggaaacattctgagtggcatcaaggtcccactgtattaaaaaggctcaacctttaaatgcacaaacaaaaggggaaaaattctcagcaggagtaatggggcagtggaaatgcaactcagcaggagggatggggcaatggaaatgcacctcagcaggagggatggggcagcgaaaatttttcttttggcgactacatggggaagcaggtacttggtggatcagggtacatcttgaggtcaggacatccagcgctgactcagggctggaacaatctgtggtttttcccaaaaaacacagtaaatgaagtcagtctccacatatagaacctttcttcccattatgcttgggatgactgcaggaatggccaggggctgagcaatttgtttctatagatataaaaaccttttccttctctagtagtgtcatcaatccctttctcagaaatttttacctaagttgtatttgagaacaattattgtattgaaaaaggggaaagagataagcatagaagaaaggacaatgtcatctgtccacctgaaacccagagaaacattattccggtttacagagttctcacagctgaaagtgaatcatgcaaccatgtatgaaaccatgttgtaccaatcagatgacctattgattaaagtgagacataggcttagattttgcaaaacctactttaacaagatttctaaaacacattgagcccccttctagcccaaaatccaaagttagggaagaaaagatgttacatacttctagggcatgagggcttgtttagaagcagttctctgagggccattccaacctctgttatcaggttactaacagtctagttcaaatgtgtcaccaaagatgagttagcagcagcagcaccatacagaaacagcagaaactgtaaggcttcagctaaatcatgagtcagttgaagccaccagaaccagatggaaggcaaggagaagttctctgctaaacttcactctacaaatcaatacaagtgaaacacaatatcaaggaaaggttgcaaggataactatgggtgtgacctattcctgtcaattgggtactacttatactttttccaaatataacatgtcctctcatgtatatttcttcaggcaaaaatcacatgactctgcatcagcataacttcacatgagtctgcttcagcaaaatatcacctgaaccttcatcacatgacacaaccagaaaattctatttcagtggagagctggagtctcccactattgaagtgtggagttcaatgtgtgctttcatttttagcaatgcttcttttacaaatgtggatgccatttctgtttggagcatagatgttataaattgagatatcatcttgttagatctttcctttttatgtgttatgaagagtgctgccaggcttcttttgattaattttggttgaaggtatattctaatatatattagaatggctactttagcttgcttcttgagtccactcacttggaaaaaattgccccacatcttactctgaagtagtgtctttctcttttttcctaccactctaatgctatgacttttcatggtatccctgattcactgaatattttgtgccaagaattttttttttagatttaacaatttttgactgatgtatcattttcttacattctatcttgtatgcctaagattctttcttctgtatccagtaatctgtttgtgactcttgcatatgttgttcctattcacttacctatgttttccatctcaaaggttccctcagtttttcttttctttactgtttctatgtccagtttcaggtcattcacagtcttacttattttgttaactggtttaattgtattttcctgtataactttaagggatttgtttgtttcacctttaaggatctgtacctgttttattttatttttctgtttttttttaagagattgttttatttttgtctttaaagacctctatcacattaataagattggctttatggtgattttcttgtgcttcatttgagttaggatttccagggcttgctgtagaaagttggttgtgctctgaaggctttatattacctttgtcttgttctctgtgttctgagggtgtttagccatctgaatggctttcatcactggttagtcctgttgtattaggtatggggattgagcttaacctctctagtcctggtgtggcagtcctctgatgtgtatccatgggtgtatgtttcctgatcaccaggtttgaatggttcatgatctcttggtctgatgaaggtggatggagaaatggcaggagtgtggaggtccatcagggataccaaactgctcagtgaagcttggggttcccagtgaattcagtgggcaagtaagatgagtgggtgaagataatgtaacctatacacttcaggatctgcaggactgatgaaagtggttgaaaagggcagtagggtaataacagtatatccacactctttttgattcaagtggaatgaatatgtttgccatgtgatttctgagtatcatataaactagcaaattatgaacataataaataagaataaaataacaaaatatctctgtataatattcagccaacaagaatatgttttcagagtatgtacaatacattatttattaagttgatttaaaaaaagacaacagcttgaaaagagtacttcaactatgtcaaagaatataagcctgttttctgccccaatatggggaatgccaaggccaagaagtgggagtgagtgggtaggggagcatggcggggggagggtgtagggaacttttgggatagcatttgaaacgtaaatgaagaaaatacctaattaaaaatttaaaaaaataatataaacctgtatttgctattaatagaactgcaaatattatcacttcctacacaattaggacatgacaaaattccaaatgaaactgacatacagtatctggtctaaatgaatgaaagaatacattctaggagcaagggccaatcataaagagagtcattaatagatttaatagattctggacacatccaatctatcaattgaataaatgaagattaaggatcataagactagtatacatgtataaaagcactgagaagaggtacaaaggtctaagcaaatagcatcatcacaaagtaataatcaggtaaaatagggttttctttatttaatagaatagcaccttcctttcattgcatggccttaacttaaacaactaggtagacatttgcttaagtagtctgtcattgcatccatctgcaatgacagacacagaaaccctaccaatattttttcagccaaatccatttccaattttcaaattatttaaattacagaaagctatctaaaggcaatacatggtgttctgcaagaaaatggttttgatctcatgaacatatatcaactttagtaaaattttatgaattataaaaaaataaatacataaaaagaaaatggtagaatatcctttggtgtcctccatttctaaattttaggaactgctgatttaatattacttttcaaatgttctctgatctttatctaaaggaatgacttttataggattaatacatcattctttacagaaaatatcaatttgtttacttatatagagtggtctgttgttattttttcttacagaagttggtattcccataataggaaaatttcgtagaagaggataatgcagaagcattctctgaggattgaagtataacccaaagaaatttagaacgtatccaatgcaaatgtataggtaaagtttctgaggcaagattgaactgcgggtgacttctgtactgttttataaaaaggaatagaagccaagaatatatttgttgtaggtacagtatgctgtggggaaaggatttgcctctgtgggtccatgcagacgcatcactagacactgaggtaccagcacaatgatggtatagtatagaatagagtttaatcagggcatgggaactggagttgagggagtagaggcagggaaagggagagaaagagagagagagagagagagagagagagagagagagagagagagagagagagagagagagagaattaaaggcagaaagactggccatgagcacatgaaaagtgaagatggaggggaatggagagagcaaaggataaggaataaggaaggagcaggagcaagaggggaggggagtgagcaagagagaaagagagcaagagttgaggactggcaagtaaactattttatagtgagtcgggcataccttgcctttgcccgataactgtggtgcagagcataaacaaaatgccaatgtttccctattttggtttaattaaaaaggagaaactaagaaaggatgatggtcaagtaggaatatggtctttgtgtacttgacctacttcctgctgactttgatgcaaggtatccctgggaaacctaagaaagtgagtatggaaatgttggtccagtcttaggagacttgtctgattccttgatgtccagggtgtatagaaccatctgtggctatataagaaggaacaggttcagtagtagagacatctgtggcttgcttctctggagctgtcctgaatataatgaacacctggacttgacaagatgctgactcatgtgcatatatatgataggttgagaatgaatttaagtaatttggtaattttcttcctaaggtatgtatatatttgaaatcctgaagtcttggtggttgtgagtgagatgagtcccaattctaggaccaggagcaggatccaaccctctagaataggaactcaggctactgattgccagatgttcttatctggatcaaatctttatggtctgtgagagagaagtctgagtgggtttcctgtagcatataaatttagaaagtgataaatttgttagcaacatgaatagtctttaagataatcttagagaagataaaaaccttcatgcagcagaagaaggaagaagcaattttttctgtttgtctaggagcctaaatatccacaaatttagtatatcaaggaaaaaattaagcttacattttaaatacaaagtgtaggactctgatacgcagcctgttttctgtttgagatagatttaaacacaggagacgcagcagataactgcaagggaccgaagccatttgcatgctgcactactagacaccaggctcctgatacaaggtctcagctctccataattctgtggctatcagtcacataaggtaatgccccaagcccctccataggtagcagatgtgactacagatcacatagcctaaaggaagatctccattttaatgaagaatctaaaatcctgaagggcttagccaattaagctctccttctcagacactgaaaaagatatttaacatcaggcctgcccttagaaactgggttaaggtttcactcatcacaactctcccccatgccaataaatgcctgaaaaccctggacagtgtcttctcatttaggatccaacatgttggagcaatggagcagatctttctctaaagagccacatctaacctcccacaggaagattcactgcactatctgccaggtcagctgccttaccaagcttggaaactctcatccctggagaacctgctctcctcctctccttttccatttggcctcaagctgaagcctgcccatggacccctgcaacattcaaagctctttggagacattgagctggctcctgacagttcccctgtggacctcagaatgtgcctcctcaagcgctgagcatggtcatgcagcttctcacagccccatgcccacccagcattcctgtgcggtgtccacaatcaaacttcctgtgttttgcatcacccaggagcctgagcactgggctggatgtgggccacaatgttaacccacaacaaagaaaattcaaattcttgaccttgcaaatatgatatttgatcatacagtttagcaacagaaaaaccttatgacaatcatgggaaatgtatatttgaatttgtgattatacaggtggattgcttactggaatgtttactggggttagcatattttataagaagactaatggttaatgttaggagagtggcatagcaaggagaagaaatatgaaccctttagtcactgggaactgaatttagttaaggataacataaagttacacttgtgaaagcttacatctgaacttgtgtatcatttattgtgaagtctgtataaaatctggcagtcttaacaagttaatgaatttactaatgagcaaataaggttgcttaccattgggtaaggaacaagttctgtttttctacagctatcaagctagttattttagcagtacatctactcagaaatctgtgaagattaaattataatctttaggtcatatattaattaaaatggcatgttcatctatggtccaataactaagcaatccccaggtccctgttctctccatggcaactagggaagaatcagactggctatcaagccctgaaaacaaaaatatacttttttcctcgctcggtccccctccctccatagagtagatacatgtgaaatgacaagcaacacacattgtcttaggcaatataagacatttgactctcagggtatcttgtttgtccacagagtagtccaagccctggcagtgagaaggacaatggagtggtgtttcttaatggttgtcataccaccatccaagtagaaacttttccctgtacccaatatcttctaagagaccttggtagaggggtaactgttaggctatagtagtctctatctgtcataatcttaaaggttattacaaaacagcttttcttcccggtatccagcaacaatttattatgcgaatcagtataggaaagcttaggttttggctatgatcttctccagcagaatctttttttttttctcatgccacttactcatagctgaagaggtggattaaagactgcatcccaagttaagtcacagttactgtgcactccttgattatctgaagataacaaagggtgtgatttggacccaaatcttataaagaaaagccctatgatgaaatgacactgtgaaatccatctaacagatatcaccatctttacccagctgagaggggagcatcgtctgatagccagaactgagtggaatgggataatttcctgtgagtgactctgcgagaggattctaatccggagtgggaaaaacaagacctcctgtttctcttttatggccaaggcaagctaggatgacaagatctttggggggaaagtctcttggtttactaaaaacctgtactgctcccaatcgtgaatgaactgtgttgggatggtgggcttccactttgcaaatgtaatgacagaataattaggagatgaggcagaggtggtctttgggcagagttgattgcccttatgctttccacatctggggaatgtaagctagtgtacttcatctggggtttgtcttattcttctagatcagttccttgcctggatccagaagttaagttccttttcttattcccctcaaataaatgatacttagcttgaaaaacgctgtgctctgaatagatgatgaaaagttcagccctagaaccacttccatgttaatgaagcatttcttaataagtcaacactactctcaggaaaccacaaagcaatatagacaaaggcatgcttcttctcctcacccaaagaaggtactagacaacgtgggttcccatgacatatctgtaagactctctgtgctagactttcctcagtataagcatctcattctggctacaaggtcccccaacgtttccctacttctgcccaactcttctaaggctcttggcttatgagtttattatttttaacattgaaaagaaagttctgcattaatggcttccacttctagccatttagatcttagatgctaggagagtgggctgagggcatggatcaattcacagttagctgttctggccattggggacacacttgatcataactttcagccccactccatttttgtctgtttcaaaggcttcaactgccttgtccagagggaatttgtgggtaactaagggcttttttttctttttctttttttttccatttttattaggtatttagctcatttacatttccaatgctataccaaaaatcccccataccccccccactcccctacccacccactccccgtttttggccctggcattcccctgtactggggcatataaagtttgcaagtccaatgggcctctcattgcagtgatggccgactaggccatctttagatacatatgcagctagagacaagagctccagggtactgcttagttcatattgttgttccacctatagggttgcagttccttttagttccttgggtgctttctctagttcctccattgggggctctgtggtccattcaatagctgactgtgagcatccacttctgtgtttgctaggccctggcatagtctcacaagagacagcaatatctgggtccctttagcaaaatcttcctagtgtatgcaatggtgtcagcgtttggaagctgatcatgggatggatctctggatatggcaatcactagatggtccatcctttcatcacacttccaaattttgtctctgtaactcattccatgggtgttttgtttcctattctaagaagggtcaaagtgtcgacactttggtcttcgttctcttgagtttaatgttttcagcaaattatatcttatatcttgggtatcctaagtttctgggctaatatccacttatcagtgagtacatattgtgagagttcctttgtgattgggttacctcactcaggatgatgcccttcacgtccatccatttggctaggaatttcataaattcattctttttaatagcagagtagtactccactgtgtaaatgtaccacattttctgtatccattcctctgatgaggggcatcttggttctttccagcatctggctattataaataaggctgctaggaacatagtagatcatgtgtccttcttatcggttggggcatcttctggatatatgcccagaagaggtattgatggatcttccggtagtactatgtccaattttctgaggaaccgccagactgatttccagagtggttgtacaagcttgcaatcccaccaaaaatggaggaatgttcctctttctagacatccttgccagcatctgctgtcacctgaatttttcatcttagccattctgactggtgtgaggtggaatctcagggttgtttttatttgcatttccctgatgattaaggatgttgaacattttttcaggtgcttctctgccattcggtattcctcgggtgagaaatctttgttcagttctgagccccatttttaatggggttatttgattttatggagtctagcttcttgagttctttatatatattggatattagtcccctgtccaatttgggataggtaaagatcctttcccgatctgttggtggtctttttgtcttattgatggtgtcttttgccttgcagaagctttacaattttatgaggtcccatttatcgattctcgatcttacagcacaagccattgctgttctattcaggaatttttcccctgtacccatatcttcgaggcttttccccactttctcctctataagtttcagtgtctctggttttatgtggagttccttaatccacttagatttgaccttagtacaaggagatagtactggatcaattcgaaatcttctacatgataacagccagttgtgccagcaccatttgttgaaaatgctgtcttttttccactggatggttttagctcccttgtcaaagatcaagtgaccataagtgtgtgggttcatctctgggtgttcaattctgttccattggtctacttgtctgtcactataccagtaccatgcagtttttatcacaattgctctgtagtacatctttaggtcgggcatggtgattccaccagaggttcttttatccttgagaagagtttttgctatcctaggttttttgttattccagatgaatgtgccgattgccctttctaattcgttgaagaattgagttggaattttgatggggattgcactgaatctgtagattgcttttggcaagatagccatttttactatattggtcctgccaatccatgagcatgggagatctttccatcttctgagatcttccttaatttctttcttcagagacttgaagttcttgtcatagagatctttcacttccttagttagagtcacggctaggtattttatataatttgtggctattgagaagggtgttgtttccctaatttctttctcagcctgtttgtcctttgtgtagagaaaggccattgacttgtttgagttaattttatatccagctacttcactgaagctgtttatcaggcttaggagttctctggtggaaattttagggtcatgtatatatactatcatatcatcttcaaaaagtgataatttgacttcttcctttccaatttgtatccccttgatctccttttgttgtctaattgctctggctaggacttcaagtacaatgttgaataggtagggagagagtggacagccttgtctagtccctgattttagtgggattgcttcaagcttctcaccatttactttgatgctggctactggtttgctgtagattgcttttaccatgtttaggtatgggccttgaattcctgatctttccaagacttttatcatgaatgggtgttggattttgtcaaatgctttctcagcatctaaagagatgatcatgtggtttttgtctttgagtttgtttatatactggattacgttgatggatttccgtatattgaaccatccctgtatccctgggatgaaacctacttggtcaggatggatgattgttttgatgtgttcttggattcggttagcaagaactttattggggatttttgcatcaatattcataagggatattgctctgaagttctctatctttgtggggtctttttgtggtttaggtatcagagtaattgtggcttcatagaatgagttgggtagagtaccttctgtttctaatttgtggaatagtttgtgaagaactgggattagatcttctttgaaggtctgatagtactctgcactaaacccaactggtcctgagctttttttggttgggagactattaatgactgcttctatttctttgggggatatcgggctatttagatcattaacctgatcttgattcaactttggtacctggtatctgtctagaaacttctccatttcatccaggttctccagttttgttgagtatagccttttgtagaaggatctgatggtgttttggatttcttcgggatctgttgtcatgtctcccttttcatttctgattttgttaattagaatgctttccctgtgccctctagtgagtctggctaagggtttctctatcttgttgattttcccaaagaaccagctccttgattggttgattctctgaatagttcttcttgtttacacttggtttatttcgcccctgagtttgattatttcctgccttctactcctcttgggtgaatttgcttccttttgttctagagcttttaggtgtgttgtcaagctgctaatgtatgctctctctagtttctttttggaggcactcagagctatgagttttcctcttagaaatgctttcattgtgtcccataagtttgggtatgaagtggcttcattttcattgaactctaagaagtccttaatttctttctttattccttccttgaccaaggtatcattgagaagagtgttgttcagtttccacgtgaatgttggctttctattatttattttgttattgaagatcagccttagtgcatggtgatctgataggatacatgggacaatttcaatatttttgaatctgttgaggcctgttttgtgacctattatgtggtcaattttggagaaggtaccatgaggtgctgagaagaaagtatatccttttgttttaggataaaatgttctatagatatctgtcagatccatttgtttcatcacttctgttagtttcactgtgtccctgtttagtttctgtttccatgatctgtccattggtgaaagtggtttgttgaagtctcccactattattgtgtgaggtgcaatgtgtgctttgagctttactaaagtttctttaatgaatgtggctgcccttgtatttggagcatagatattcagaattgagagttcctcttggaggattttacctttgatgagaatgaagtgcccctccttgtcttttttgatgactttggcttggaagtcaatcttatcaaatattagggtggctactccagcttgtttcttcataccatttgcttggaaaattgttttccatcctttcattctgaggtagtgtctatctttttctctgagatgagtttcctgtaagcagcaaaatgttgggtcttgtttgtgtagccagtttgttagtctatgtctttttattggggagttgagaccattggtattaagagatattaaggaaaagtaattgttgcttcctgttatttttgttgttaaagttggcattctgttcttgtggctgtcttcttttaggtttgttgagggattaccttcttgttttttctagggcgttgttcctgttcttgtattggtttttttctgttattatcctttgaagagctggattcgtggagagataatgtgtgaatttggttttgtcgtggaatactttggtttctccatctatgtaattgatgggtaatttggctgggtatagtagcctgggctggaatttgtgttctcttagtgtctgtataacatctgtccaggctcttctggctttcatagtctcaggtgaaaaatctggtgtaattctgataggcttgcctttatatgttacttgacctttttcccttactgcttttagtattctatctttatttagtgcatttgatgttttgattattatgtgtcgggaggaatttcttttctggtccagtctatttggagttatgtaggcttcttgtatgttcatgggcatctctttctttagatttgggaagtattcttcaataattttgttgaagatgtttgctggtcctttgagttgaaaatcttcattctcatccactcctattatccgaaggtttggtcttctcattgtgtcctggatttcctggatattttgagttaggatctttttgcattttccattttctttgattgttgtgctgatgttctctatggaatcttctgcacctgagattgtctcttccatctcttgtattctgttgctgatgctcaaatctatggttccagatttctttcctagggtttctatcttcagtgtttcctcacttttagttttatttattgtgtctacttccctttttaggtctagtatggttttattcatttccatcacctgtttgtatgtttttttcctctttttctgtaaggacttctacctgtttgattgtgttttcctgtttttctttaaggacttgtaactcttaacagtgttctcctgtttttctttaagtgagttattaaagtccttcttgatgtcctctaccgtcatcatgagatatgcttttaaatctgggtctaggttttcgggtgtgttggggtgccctggactgggcaaagtgggagtgctgggttctgatgatggtgagtggtcttggttcctgttagtaagattcctacgtttacctttcgccatctggtaatctctggagttagtagttatagttgactctgtttagagattgttcttctggtgattctgttactgtctatcagcagacctgggagacagattctctcctctgagtatcagtcctcagagcactctctgctggcaagctctcttacagggaaggtgtgcagatatcttgtgtttggacctcctcctggccgaagaagaaggcccaaaacaggacctttctcagaagctgtgttgctttggcgggtcccagaagctcttagcttccgtggtgcagactctcacctgtgcagactaaattcctaagttcggtggagtccgggaaccaaggtggcgcccgctgttcctgaggctgaggccgcctcccgagccaggtggacacaaatggttctgcctctgcggctctgtgcctccgcctgtcccagaagctgtccagttctgtggagcaccctctcacctgttcagactaatttcctaagttctgtcttccacatttcttaaaaagaaacaaacaaaaaaaaaaaaaaaaaaacccagcaaggtcaggcaggtctgtcacagcaatagcccacttcctggtaccagcttctgtatagatgcttttcaattgctatcaactaagggttttacattcaaagtcttcaacagaagcatggaaattgccatcgaccacatgttgcagtgtcaaaacaatcctttgatatacacttccttcagggatatttttactaggggtaaattgatcatattggagcccattcccataatcaccagattaggtggcatagaaacacatctggatggaggactctgctcctgggcattcattggtgacctccagcttgctccccagcagaatgcccaccttactggcaaattcctgtggggtcactttgggaaactttatggtaaactctggtcccaactttcttgccttgggtcaactgagaagcacataagtcagtcatcaccacttgatcagctcccattgctttgccaacaaacaaaatagacatcccaaattgttcaggtctacacacaggaccttgtttgccaggataactaaacctcaatagcaggcatagatccccacagagaggttcaataagggactcttcttcacaggtgacactgttaggaagcttgttgcagaagtcaacacagtgcttgtaaaatctgaggagtgtgccacaaaagaagatagatggtgtcaggttgtattccctaatctggcagtactcatctacttctcatggaatgccaggctggatggtaacccgatctcctgattttagatgtttcactgaagctctttctttgtgactattctagcagcctcatgcccaagctccattggctttttcataacaaaatacccaatatagccattctcccagaggtaagcatctgagctcctgatccccactggatgcatctttagaaacccgttgtttgagcccaggtcaggcatttagtagttctccaggtgaatgtctccaagactgtgtaccacctgggagaggttcttgcctttagatggcactgtcatgaggctctcttgcttcaagtgtcggctagacttggcagggagctggtacttctacatacatcggatttctgaaaatattgatagcaagtctatggagcttatctgacttagacaacttgcatttatttaattacttatttaagaatatatttagcaaataaatatcacatagtaacttaatggtagtagcaagaataaggatatatatatatatatgtatatatatatatatatatatgtatatatatatatatatatatatatatatatatatatatattacatacacacacacacatatacacacatgcgcaggagtgcgcgcacgcacacacacacacacacacacacacacacacacacacacatatcagtgatctttaaccttaatactgtttagctgatgtggaccagaatgagaagaacccagaaagctgacaacagcggtaggagctgtacaaaaccttagctgaaccgagtaccagggaggaacagtgtcacccaggaaggttcaagtatgtagcatgggctgaatgtgtgatcacacaggcaaacatcttactctttgcaatgtagtgtctcatacaatgtgacagctagaagcaaatggctgtgggagtatgagaaaggggtttgggacagatgttgtcagggaaagcagtgactcagcagaagagtgtcccaggcagaattcagaagggcaaggtgactggtgaagagcagcttttccataggagcagaatgaagaggtacagcaaggccaggcctgccagcccaagtttccttctccaagctggaagcccaggaccaggctgtcagaatctgtgttgggtgggtaagggaagcacctgaagtagctttctgtctcttcacaaatcaggctgtagcagctggaagatgtgcagagtgcaagagctaagagggtcaagtaggcacaggaaagtagtctctcagcagaacagtgttccaggcagaatggagaactgcagtggggctggtggggagctgcttttctgctgcagcatcagataggggtggcaaaccagtacagggagcagagcaagagcagagcaaacagctgataataacggaaggaggggaaaatcatatggagcaacagaaggagaattattttgagacttccaattaaaggccatgtagagatattgcttgctgggtactatgactcagacctagaaataccccagtatgtgagaacaagcctgcaaagactaatactttagatgagaatagagttattaattacccctacaagtcttgaggataaaattagtaagtagagattgacagtcgggtcagatcaccaggtggtcaagctattaacttggggactaggctctaggccaatgcactgaatcatggtgcctaggattttgcagcatcaggaaagggactgcctcagacaagagagaaaaatctaacctaagagaaaatgtcctagaatgaagggttagtgagaagaacagtcttaagtattgcatgtctctgtcttcaaggacagcaaagtggtgaccccaagttctataaacctcccttgagaccagaagatatttacactgaccagcttagttgttctccaaagtttatgtggacaggtctaacaagagatggctctccatgtagcattggggaatgtgagccttcaagtgtctaaatccagtcctttggcaccagtgttgtgttttataaaaagttaagaagctgtgcagtggtggcacacacatttaatcccagcacttgggaggcagaggcaggcagatttctgagttcaaggccagcctggtctacaaagtgagttctaggacagccagagaaaccctgtcttgaaaaataaaacaaaacaagaaaaaaaaaaagggaaggaatatgtttggtgtagacatggtaaggtgtttggtaagtggtgcctctgcaggccattgctgaggtattcctttcctctgggttaccagatagtatatcacaagataggaagatagtatagtatagtatagtatagtatagtatagtatcgtacagagatcattcagggaattgggtggggagttcagggggatgtaaatacagagaaaagcagagagggggagggagagagtataatagtataagagtagaggcctgccataagcacggggagagagagggggaagggaatggggaaagagaaggtaatgagcaggtacaagtggaaaagtgcaagaccaagagagcagaagactgaggagggggaaagcagcccctcttctagtgagtcagccatatctgcctcttgccaagtaactgaggggcaaagcctagataaaatgccaacaactcccatttaatgtacttcctttgtagttctactttggggattaactctagttatattattatgatagcataaaggagcacaaataaaatattcctgtacacctgtctcacttttctaagtgagatttggtattgcagatgaggtcttttgtattagtctgtagatgctcctgtaaaggagaagtaataatatggcagattaatacatcagcttgcttattttatagagaaataaaacaaaggaggttaaagtgtggataattatgaataataaaaatatcatgtgttttctcacaaaatatgttatagttcctagaaaatggaatcagaacagaatgtgaatatgattttagactattaccgacacaaatgtttcagaagatcagaatgcctcacgttctattttgattgatcattgtgttatttctgtgatcctacttctgtgctcataaagatgaactggtgaaaacacacacacacacacacacacacagttagagagtccctaagctttatgggttaagcttgcactggtcttttgtatgttaaggacagaatctgattttatttttcaaggtattaaaatagaatttacatcaatatgtacatttgaaatcatctttccccttaggaagaagtgaggtcagcaggtagtgagagaaatagaaaggatacatgaaataatctttacaattcaaatgtggtaatgcaataataattatgtccctgtcatttgatggatctacttaaatacttagacatatagacatctttatgccatgcttaatatcaatcgctctgagacacaaggaggtagacctgctgcacagtgtcatatgtaaatgcaaatcaaaagtcatgaattgacctataccctaagttacatgttgcctcaaatcttaaaaaaaaaattctatcatactgcactagaacctatattttaaagttttctccattgttcccaatgaaaactactaatagctgcctttttcaccttcagggagttattttgaaagtacataaaacacctttttctacaaataccctgtattttggaatgaccaacacaaatgataacaacaaagagtacaatatatttcaaagattaagcctgctaaaaacaaaaaagatacaaaaattgtatagaagaccataaagtttgaaattttttgatccatttttgaaaatattttattaaaaatcatttaacatttcataatttagtttgtctgaatggtttattaggagttaaaaagtaattcaatatttcttttctcccagtttgattgaatttcctttgaaatagttaagtatagaaagtgaagaaaaccacttaggagatataagatttataaagtatttgaaaagaaaaaaatcacatgatcataaagaagcctaatactgtcatatttaccatcagtgggactgtcacaagcagaggagcaggcagcacccttcacctctgcttgttggtatttttaaggaaaacaacaataccaacaacaacaacaaaaaaaaaaaaccaaaaataatatgacacatgatgtataaagaaagggatttagggttatatacaccaaaccagaattcattactgaagctgagtgatagcattcaaatgatcaggcacttaaattttacttctgagttgaaatttacagcaattgatgactggttcatggaacataggggctctattacataaagcatatttaggaatacattaataaggtgtcgtaactctagttcagtagcttactacattccccacatttgatttcaatattctgaatccttaactcagagtatggtgaaagtactcttagtatttatactgtattttattttattttattttatcaccgaggtagcagggatacaaaggaagtaaacatcaacatctacaaatatatatttggattcataaaacagtaggactgagaaaaatatcctttacactgaaaaaatgtggtaaccatgaagttagccacccaatcagatcatagtccctatactgagttggctgttcatttcaaattttgtaactatggttcttccaaaatatttgtgatacaaaaggactctaaaagcttatatatgcactgatttgccaatagtcaccacaggtagtcattttcccttttttgcaatgagaagggtagtagttcttctgaaagtggggggcggagtttcatttggactactgatatagtatttttatcaagggtcatgcactttcttctgtaactccttctcagttaaacttagggtgtcattatcaggacacaggaggtaggaactctggtccaaggccacgaaaagattaagacaatgtgtccagggtcataggaagcatattattcattgacacattctaaatagatacctcgcaaccacattagctgggataggttacatcaaatttcagccactccacagatttctggttttgtagaactgtctagggtgaatgtagtatagaatattttagagcagttttagtccatagctgatttctccatggtgcctgacagttgagcagaaatcttttgggacacatatgaactaggacagaaggcatagatgcagtacttagtggaaaatctgtaacttctgggtatatttgaaattttcactccttggtcttagtatttcagaaagtagtagcagtactgagactagtagatgatgtgcactcatacacacacacacacacacacagaaagagagagagagagagagagagagagagagagagagagagagagagagagagagagagagagacgcttaggaataggcagtaattgtataagcttagacttatgattgacagttatacttatctgcagtccacttccttatgacctgtaacaggtcgaacaatctcacaattcacggaattttttccttatgtttttatatttattacataatatttacagttatgcattctattaatttattatatagcctaatcaccattcacctcccggtctgtcctccaccccctccccatcttcctttcctcccctgtctcaaataggatgtcaccatcccctcaccccaccccatcagaccaaacctcagcataaaagtattttttttataatttagcattactacaattcataacatgtatttaaattctcattgtaaaagtctagttgggtggaggaaggggggttggagacagggaatggagaggagttataggatattgaggagtcggagggtggactataggggaataaaatctggagtgtgtaaaaaatagataaataaaagaaaaaaggtaagctaacaattgtctataagttgctggaaaatgctaatgactgtgaataatagcaaaggcagatttttgaaccattctttcttctatcaaaaaagctggaatatataatgaacagagttattttagcagagtgagaaggattttaacgttttaacgctataagtaaaggacaagtaaggaaaattttacaacttgagcttctgactatactcctactcactgctttatcactagcagattaatagtttatcccaactccattgattaaagttcacacatgaaattcctttttcagatcctatgatttggataaatctttttttttcttttttttcttagatattttctttatatacatttcaaatcccaaatgctatcctgaaagttccctaaaccctcccccagccctgctaccctaaccatccactcctgaatcttggcccttgcattcccctggactgaggcatataaagtttgcaagacctaggtcttcccagtgatggatgactaggccatcttctgctaaatatgcagctagagacatgagctctgggggtactggttagttcatattgctgttccacctatagggttgcagaacccttcagctccttgggtgctttctctagcttctccattgggggccctgcgttccattttatagatgactgtgaatcttaatcaccctttttccccagtctgatcatttttcatgacatacaaatggatgattacagagagtagtcattgaaaagcaatttctttaaataagggaatagtgaaaggtaaaattttagataactatagcaacatgctatctggagtggatttttacactgtaatttttatctgtttaaagtgaaaactgtgacctaaataaaccattttgtttgtcttcctttctcttcaggggacctagaagctctagaaaaactaaaagaaacaaacaacaaacaaacaaacaaaaaagaaaaatcaggacctgttttacatatgaaatttactgaataggcagcagttgctgaaatgataaggctaaaattagccataaatatcatcaaatttctgacagaataatttgaatgggaagtctatacaaaatattccttgtatcaagtgaaataagatagtttaccactatctgaacattgttttcttaaattgcaacagaaggaagcatcaggtttaagtttctagacccacaagatctgagagattgtcctgatgtaaacaaacaaacaaacaaacaaacaaacaaacaacctgagagactggatcaccattgtgaggcaaacaggatctagaggaaaaggacaattttgtctaacagttaccagtaccacaatattggtggcatcctcttctttggaaatgttcatagaactgctgcaagaaactggaattgttaactattaaagaatcttaattttggattttttttttattttggctttcttttcttcattagacactttactgcaatacttagcagatctctgttacttccaaagagttttgagggccaccaattaagtttacctcattttaaacaaactttacttgttttagttttttgcttcagattaattcttgaaaacatctacagaagatgaaataaagcttttcccaattagtaaattacttatgtaactgatataactgaaagcatagttctaacaacactaacaaatttagccttttataaggtacctggccattaattgtcttgacttaattctatttacaagtttataccttggactttataaaattagaattttacagctttcacattactaaattttaaacttaaattatgatttggagatcaaacatcaaacataaaatattaaaccataagtagggtccacacagggtggataatatttattttattgattttttatagtacacatttataggatatcacagattttttgtataaatcagtttcttcaaatagctgtaacttaaataaagttagcaaaggcaacatattacacatgcatcttgaagtcagtttgcactagcctgactagaacttaggagtttataacaatttatcaaacatgtccatttatccaacttatgatattctttcttttgcaagttccttttccaccaagtcgtttccttttatctgcacctaagaatgttttattgtccttttataagtgatattcaaggaccctctcttattcttaccctctccttcagctccttttgaatatggaatgggtacctatactttctggctaacatccacttctcagtgagtatacactatgcatattcttttgcatccatgtgacctctgttagtatgaaaatttctagttccatccatctgcttgaaaaattcatgatgtctgtttttaagtagcttagagtattctattatgtaaattaccttattttgtgtatctattcttcaggtgaggcgactctggtttgtttctagtttgtagaaattatgaatgaaagaactattagtatattggagcaagtattattgtgctacattgtagcatcttttgagtatatgctcaggacgattatagatagatcgtcaggtagaactatatccaattttttaagaaacctacagattgttatccacaatggttgtaggtatgagtaatcaaccaaggacatcaagcactctccttcaaggaactatgaaagaaatttaaagaaggggttagataaacatacaaccctgtagcattacagacatgacaccatcagtacttagcctatttaaactaaataataatttctactggacaatacacaggctgtattcaggaaccatggtaaaaaaatacttgaaagctgtagaattgtgcctcttctatataaatactatccagatattcaccaattttttgatggtgttacacaaatagcaaagtttaatatttattgactgaatagatggacatgttgtttttaggtaagtcatgcctctgtaaatgtaatactgcagttttacatattcttgatgatagtcacttctggcatgatttgaaaatacatcactccatttgctgagatgtatttctgcgggctatgatttctccgtttctttcttaatggctgtttttttttctttgtgttactatatatattagtgattagaaatgggataagatggggaaaattgtggctcaaagaatattatgaatataccagttgcaatgtcttgtctctctaggttcatttcagcagagtagatgcaggaaactatcacctacataatagttttcatccaccaatctgctagccactagaaaatatttctctaacaagctgtctccttatacttatggataactttatctgttgaaatatatatcactttttctttgtgttcttctaagcatcagggcttgatcaaatttgaatgacaagcaaattaaaggatagtctcatgtatataaagtgagtttgagtggactctgctagctcagatggaaagtactgcgtctttttggaacttttgtaaatttctttaacacaactagatcaaggaaccagattattgtataaagttatttattgtatataacaagaaggaaggattatggtatatgaaagggtatgcatgctcatatactctgtattgcagcatatcccaactgcaggcatctaatgaggtgaaacctgtggccaattgtttctatgtacactgttaacatccccatggaagttgcaataccacctagacttacatgggaaaaaaatttataaatatagtggatcagcttattgggttattttacattgccatggccagaaacaataagaaacatacttgtataatttaataatctcacacaagatttctatatatttcttgttgttttgtggtaagataaacatgagtgttcatacatacatatattaacatggcttttaagagtataagaccttaacagctgtcatcctatactccctttattaattctataattttttaacttctgatttaaatgcagtatattattttgggtacaccaactgtgagttaaaccataaacaaactcttaattctacctctttgagaggctatcagtcttcagtgagccaccagcccaaaacagaactgaattactgatgggaatattattcaggtcataaaactcaacaagtatacaacactgcctgtttaaaaaaaagaagatgcactctttcaaagtgcatagttctgggaaagtctctaaatatattaactgtgttttctttggtttggtttgtactgttttgtttttttgtttgtttgtttgtttgtttgtttttctgcatttttagttctgggtgttcctgataaatataaatatatcaacccaagctataggtgatgtgttgaaaatctcatcctgggaaaatatacagaacaaaggatgcaattactggataattaataaatatgtttccattgccttaatcttgtgtttcagaagacttcttttgtagacacatcactacacctccgaatcctataaaactatatttcactagccttatgcttgacagatttttatatttatatgatttaaccagggcttgtacatagatcttgtgtgcacaatggccaatatatgaactgagctctccatatagcctcattttttcttacattttattaatatatgaatgaaatcataaatttctgttcttatcagttgtttgactagttttgttatcaaagccatcatatacaattgtctggaaaaaataatttaacatgcatgattattataaataatttgcattaattattaaaatattttatttactaacacgggaattaatcctgaatgttcatgattagaacctaaaaaacaaccacatgaacttggaaggagacactctcctggcaattcttgaattcagatttcaccatcagccataatctacatctacgttttctgactggaagacagtgagtagttgccatgtggctcctcaaagacattattcatttattttgtacaataaaggcataacacagatagaatgatgcattagttggtatgaagttgagaactaatcatagaaaatgatggcattagagaaatataaaaataagtaaataactattttacaagtagtttgggaagtttccactgtaatttgcacaaccatatacactcttcacatgtacaataatactccccacctctggagatttttgaactctatagacctttctagatataagctaaggggtatgtttaaattacaaaagtagggtggttaataggatagcagcagaggccagatacatcaattgggacattattggactcagttcagacgttgaaatagaggataattgaagaattgaagaggatataagaggaatgattctgtgaaaattagcgaagtttttgcacacaatgttagtgcctgacatgcaatatgatgtgtccaacattaatgtatgtgtcaaagaccaactatgacactgcagagcaaactacagaagtctgcaagtcacaatggcatgagttagttgtaagagcagctgcaggaagctggtccagataatgacaggaactgctgcctatgtcaggcagtgataagacaggatatgggggtccaaacatacaaacacacaaacaaacaaacagaatggttgaaacaactgccaagtttcagcaatttgttttttctctcaacagctatttagatcaattaagacaaaagtgtttgtactacacatgtcctagagacactcactagcaaaacataatcttcaaacacagattaaaatctatatttgttaccttaaaccagtaattatttagtcattgattaacaaagtttgaatagtccaagtctatagtagcaagttaaagcctgtgcttggttgacaatcatctgcacttactcaagagcagtttgcatatctccatcttatttttgaagttcagatcagctaaggtggctaatcattcattctctgttcttaaaataaaaatatttgttctttattgtaagcttagggtttcctggagcccatagaaaacctgctaccttattcctagatcacaagattagtgaactcaggcccaacttagactgcatgcttttttgaccaataacttgccccaagtctatccttcttgcctctcaaattacgtgcttgtaattcatgttgaatgctcactgtatgcgtttttgtaactcacacagtttttgccattctatcaggaatggtcacactgttttttaattctaacataaaaatttttctttttccaattttattatgtatttacttcatttacatttcaaatgttgtccctgatgcccccaataccccctccctgctaccctacagtccaacttcttggccctggtgtttctcatgtactggggcatataaattttgcaaaaccaatagctgactgtgagcatccacttctgtgtttcccaggcattggtatagcctcacaagagacagctatatcaaggtgctttcaccaaaatcttgctgccatatgcaatagtgtctgtgtttcgaggctggttatgagatggatccccgggtggggcagcctctggacggtccatcctttagtctcagctccaaactttgtccatgtttctcagcctgtttatcctttgtatagagaaaggccactgacttttttgagttaattttatatccagctacttcactgaagctgttttatcaggtttaggagttatctggtggaatttttagggtcactcatatatactatcatattactgcaaaaggtgatattttgacttcttcctttccaatttgtatccccttgatcttcttttgttgtctaattgctctgactaagattacaaaaactatgttgaataggtagggagaaagtgggcagccttgtctagtccctgattttagtggggttgcaaggattttattgagtatttttgcattgatattcataatggaaattggtctgacattctctatctttgttgggtctttctgtggtttaggtatcagagtaattgtgacttcggagaatgaatggggtagagttccttctgtttctattttgtggaatagtttgagaagaactggaatcagatcttctttgaaggtctgatagaactctgcgctaaacccatcttgccctaggctctttttagttgtgagtatatgaatgactgcttctatttcttttggggatataggacagttttggtcattaatctgatcttgatttaactttggtacctgttatctgtctataaatttctccatttatacccaggttttccagctttgttgagtataaccttttgtagaaggatctgatggtgttttgggtttcctcaggatctgttgtcatgtctcccgtttcctttctgattttgttaattaggatgctgtccctgtgccctgtagtgagtctggctaagaatttatatatcttgttttctcaaagaaccagctcctggtttggttgattctttgagaaaattcaaataaacaaaggtaaaatgatattaaaggaatggagtaacaataagggggcctggtggctactctagcagttcagacaggactgtgtgcaccagggacattgggacacaggtgaagctttagtgatttggggatttctgatttctgatataaactgtgaattaggtgaagtttggggataggttagtgatcttgataagcatatgaaattatttcttaagttattaaagaaatttttagttctgagctgcctgagctacatgtatttcatgcagagagcatcagtgtcgtggcacttctgagtagttacttgttggagagtttttttttaaattatctttaatctgttttttgtttgtttgtttaggtttttttgttttgttttgttttgttttttacagttcagtcattatccccttcttggttcatcctctgacagttccggatcccattcctactcctgtttctccaagaagatacccctccatatcctgccaggacttgccactccctggagcctcaatgtttgatgacttttcactcactgaggccagaccagacagttccctgacccgtccagcaggtccagttattcgaggatctcgagaggacctcctcctaataaccaaatggggggtagagagagacgagggccttgtgcgaataacgacacagaaaccgttctggaatgcatcaaagcccccaaatgtttttgccaggcccgaggtttaaatgtacaagcaaaaggggaagtgcctttcagcaggaaggatggggcagtagaattgcacaaggaaacagggaagtacagatacttatcagcgggagggatggggcaatataagcaaaaggagaagtatttatcagtgggagggggggcaatagaattgcacattcttaggcagttacacggggaagcaggaacttggtggtatcagggtatcttgaagtcaggacatccggcgctgacttagggctggaacaatctgtggttgttctcagagcggtgtgtcggtggcctgcttttgaccctcttttcttcttggggggagaggcccaattcagagatcaggacaatagcgttgcctaaatagctcccaacagttccctgtctgaaaaggagacaccttagataaaatgcccaacactggggagagggagcttgtagagtccacttccagtagaaagataatgcctcagtggagggatgaggttgtcattccacagtcacaaactctgtcccagagatgtagctgtctcttgtgagactatgccggggcctagcaaacacagaagtggatgctcacagtcagctattggatggatcacagggctcccaatggaggagctagagaaagtacccaaggagctaaagggatctgcaaccctataggtggaacaacattatgaactaaccagtaccctggagctcttgactctagctgcatatgtatcaaaagatggcctagtcggccatcactggaaagagaggcccagtggaaacgaaaactgtatatgccccagtacaggggaacgctagggccaaaaaaaaaaaaaaaaaaaaaaaatgggaatgagtgggtagggaagtgagggggatggtatgggggacttttgggatagcattggaaatgtaattgaggaaaatatgtaataaaagaaagataaaaagagaataaattcagaaaaaaaataaaagaactgcaggggcaaaaatggataaaagactgagtgaaagtgaccggcacaatttgagatacatctcaaggggctccaagacctgacactattactaatgctgttgtctgcttacagacaggagcagtcctctgagaggcacatcaagcagatgaccaagactgaagcagaaactttcactcatccaatggacaaaagctggggaaccctgtggttgaattggtgcaaggctggaagaatttgtggaggaaggtgatttcactgaaaaacctgcaatctcaacaaacctggacccctgcaatctctcagattctgaaccactatccaagcagcatgcactagcaggtatgaggcccctgacacataaacagcagggaccatgcccttatatctggtgttccatatcatagagaaaaaaattcatatgctcatatctaaaggtaagaatattacttaatgagcaatatatccagcctacatattttgatattataccaaaaagtaccaagtgtatataattcaacatccatacttataaacacattgtagaaccctacaatttcttacaactccaggtataaagctgtcctaagagttcattctcaaatttaaatattatttttctgactactttatttgaattttgaaaaatgggaaaaaaattttgttgttcttctgtaagttctacacatatagtggaacaagataaacacagagagcacattgatgtgctcacattcagtgtcatgcacataaagcaagattctgccaaagatccacatagacatacagtaattctactttccagagtgtgacaaatgtctgttatgaagaaatgatttgtatgaacagttttctttatacgcagatttatctgaatcattacattgtgtttttcatatgtattattcaagaattataatattttgaaagtaggtatttcatattatagatattatacagcttgctacctacaaataaagcatgttaataatagtaattatatcacttaccctttccattatcttctattactttctaatccacataactgtaattctttaaacagccacactctcaagtctcttatttccttcccttcatctttgtatttttcttcacttatatagattaatatagtaaatatagtaataagtaagtatactaatatagtaatatataatatagtatatatacatataatactatgtagtactataaagcaaccaatactaaatatagtaatacagtaaaataatacctccatttcactctgttttacctaaattatccagcgaataagaggttactgtagagaacattgtctgcacattattactgcaatatttcttgaaacaaataagtaatactgaacagccatcttggccatgtgtgtctttcctactataacacagtgggtacatactcttcatgaacttgccaattctctaacctgttaatgttacttcaggatattgaaattttctctaaacgtccaatagttttcagggcatttctttttcttttcttttttttttattattaggtattttcctcgtttacattttcaatgctatcccaaaagtcccccatacccacccccccaatcccctacccacccaatcccccttcttggccctggggttcccctgtactggggcatataaagtttgcaagtccaatgggcctctctttgcagtgatggccgactaggccatcttttgatacatatgcagctaaagacaagagctcccaggtactggttagttcatattgttgttccacctgtagggttgcagttctcagggcatttcttaatttacaaggcaggctgcaatttttcaagcaggaataccagaccaaactctgtaaaagaaaacagcctgcagggtaaattccctcataatcacttaggactggcatatcctctagatagaggactcagcccagccttagttgcattgttcactacctactgtatagaatatgccactagtgatataacaagaaagctcaataaacaatgccacatggagaatagattaacattgtgttttttcccatgcaaaattcctgccatagatgatatacatgaaatttactgggagtgtgggattatcataaaatctctgcatcacagtgaaaaggtcagcataggaactttggaaaggtcatgaaacactcacccctctgaaagagagaggctaattagcatttctgagaccacagggtgggaacagacctgagggtggggacacattccacagggctgaccattgctcacctcagacaagggaagtccttgtcacctcattccctaaagaccaaccagtttaaagggtgcactattctgcacagtgtgactagttgctgatgctctgttctgcccctggaaaccatattaaaaaaaaaaaaaaaaaaaaaaaaaaacttgctgaacgggtactgcgggttgatgcctctccttcaggtctgggatgagcccagtgcactggaacaataaattcctcttgctttttgcatcaatcttggctccaagtggtacacttggatgttcccagtgagctaaggctccctgaagtcttacaaaagtcccctcatattgggttctttcccttacctgaaacatcccctgatatgagatagtgtttgctcatacttcagtaggattcagtaatgttcaaggccaaggaagcttggaaaaatattggggctccatgaaccctgttttatattacataaaccttgcataattactggttagaggaaaccactttcaggggaactgcctgcaatttgagcagatacctctaactctcctttatggcagatttcataagttgtaactcattttacaaggggttgtttgatgaacagttgccatctattaaagtgtgccttcatgattaatagcaacaattcattggtgcaaaaaaaacagacattgagtaattcagattctttcagaatacgcctctctctttctcagatagccacttaatcctgtaaagtacaaagtaaatgggaatgtaaaaaaatatatttcacccatgttattttcagtataaatttcttctatcacactgcctattgacctgttgtcttaggattcttgtcatctcaataaaacatcatgaccaaaaccaacttggaaagaaaatcatgtatttcattatccagttcatgtttaatcctactgataagtgaaggtaggaacttgaaagcagaaactgatgcagagaacagtggtggatgtttcctacttactcattcctcatagcctgaccctcgtgatttctggtaccatccagtgtcacttgttatggagtggtgatgatcacagtaagtaggacacttccacattaaccataatcaaaatactctacagatttgtttacaggccaatgttatggatacactaaggctcttttccagacataatatatatatatatatatatacatatatatatatatatacatatatatatatatatatatatatatattattagatattttcctcatttacatttccaatgctatccccagagtcccccacaccccccactcccctacccacccattcccattttattggtcctggcgttcccatatactggggcatataaagtttgcatgtccaatgggcctctcattgcagtgatggctgactaggccatcttttgatacatatgcagctagagtcaagagctccggggtactggttagttcatgatgttgttccacctatagggttgcagatccctttagctccttgggtactttctctagctcctccattgggggccctgtgatacatccaatagctgactgtgagcatcctcttctgtgttttctaggccccagcatagtctcacaagtgtgagactatgcagggtgctttcagcaaaatcttactagtgtatacagtggtgtcagcgtttggaggctgattatgggacagatccctggatatggcagtctctagatggatcatccttttctctcagctccaaactttgtctctgtaactccttccatgggtgttttcttcccaattctaagaatgggcaaaatttccacactttggtcttcgttcttcttgagtttcatgtgtttcacaaattgtatcttatatcttgggtattctaagtttctgggctaatatccacttatcagtgagtacatatcatttgagttcttttgtgattgggttacctcactcaggatgatgccctccaggtccaaccatttgcctaggaatttcataaattgattctttttatagctgaatagtactccattgtgtaaatgtaccacattttttgtatctattcctcgtttgaggggcatctgggttctttccagctgctggctattataaataaggctgctatgaacatagtggagcatgtgtcttttttactagttggaacaccttctggatatatgcccaggagaggtattgtgggatcctccggtagtactatgtccaattttctgaggaaccgccagactgattttcagagtgtttgtacaagcttgcaatcccaccaacaatggagtagtgttcctctttctccacatccacgccagcatctgctgtcacctgaattttttatcttagccattctgactggtgtgagatggaatctcagggttgttttgatttgcatttccctgataactaaggatgctgaacatattttcagttgcttctcagccatttggaattcctcaggtgagaattctttgtttagctctgagccccattttttaatggggttatttgattttctggagtccaccttcttgagttctttatatatattgggtattacttccctatctgatttaggataggtaaagatcctttcccaatctgtttgtggcctttttttcttattgatggtgtcttttgctttatagaagccttgcagttttatgagggcccatttgtcaattctcgatcttacagcacaagccattgctattctattcaagaatttttctcctgtgcccatatttttgaggcttttccccactttctcctctataagtttcagtgtctctggttttatgtggagttccttgatacacttatatttgactttaatacaaggagataggaatggatcaattcgcattcttctacatgataaccaccagttgtgccagcaccattttgttggaaatgctgtcttttttccacaggatggttttagatctcttttcaaagatcaaatgaccataggtgtgtgggttcatgtctgggtcttcaattctattccattggtctacttgtctgtcactataccagcaccatgcagtttttatcacaattgctctgtagtacagctttaggtcaggcatggtgattcgaccagaggttcttttatccttgagaagagttcttgctatcctaggttttttgttattccagatgaatttgcagattgctctttcttttttttttcccccattttttattaggtatttagctcatttacatttccaatgctataccaaaagtcccccatacccacacacacaccccactttcctacccacccactcccccgttttagccctggcattcccctgtactggggcatataaagtttgcaagtccaatgggcctctctttgcagtgatggacgactaggccatcttttgatacatatgcagctagagacaagagctccagggtactgcttagttcatagtgttgttccacctatagggttccagttccctttagttccttgggtgctttctctagttcctccattgggggccctgtggtccattcaatagctgactgtgagcatccacttctgtgtttgctaggccctggcatagtctcacaagagacagctatatctgggtcctttcagcaaaatcttgctagtgtatgcaatgggattgctctttctaattccttgaagaattgagttggaattttgatggggattatattgaatctgtagattgcttttgccaagatagccatttttacaaagttgattctgccaatccatgagcatgggagatctttccatcttctgagatcttctttaatttctttcttcagagacttaaagttcttatcatacagatttttcacttccttattattaagctgaaaaaaagcaaaagcacacctctcatttctattcttagtaaatttcatacttgaaggaataatatatatatatatatatatatatatcccagtcaaagtatctttatttaatatgtaatacctagtgtctaagatcttcatcacagtgcaattttgaaataaagttgatgcagagaaaatattgtgagttgtatccactttagtattttaagatttatcctgaggcagttgatgatctacatctttatttaagacatttctgttgatacttaagttatggcaaatgttgtatttcttatacattaacctaacatatgttgtggtttttgtttttttaagatttttcttactgtgttatcttttatgacatagctcatctttaccttacatatttttttcatctttgggagtttagtatttctccagaaatacctgatagtatagaaatctgtgaatctaagaaattggcaccaataaacacattggacctatttgtaatgcctctctgggtctgcatggcaaatgctgtttgctgtgcattacagtctctctgggaaaaaaaaaaaaccaacatagaattttgttgtatttatatgaaaattgactaactaaataagcacactttttgtatgtcaaaagtatatgtgaaatataatgctttgagagggtaactttggtgagtccaggaaggtgcacccctgagaaattaagccatgcagcagatctggtatgaaagggatttattggggaggattgaggagtaagaatatgaacaagggatagatgcagagaagtgcacatgtagataagcagataaaaaggagcagttcagggagggcagataaaaaggggagtagagaaagataatatgccaggaacagagagagaaacaggagaacagagagagatctaggatggtggggagcccttttgctacacatacctagcactcctggcacacctggtaggtgctcaggtagctaatgatgtgggcatctgctatgtccctgagaacaaggcaaggaaatcatctctatgctaactatatgagcataccaaccccatgcttccattagttgaatctttacatatgaatttcaataaatgtgattttttaaaattttaagtgaatttaatttagtactgttttcaaatgaataattcatgattttaccaagtgttttaacttcaggtttttttgtttgtttgtttgttttgttttgttttgtttttgtttttggtcaattgatttggacattaaaggttatttacaatgttatttgctacaccttttaaaacacatttctgcaactccacttaaaatatctctgcctaaatatgaggagaaaggaggtttcagtaatcataaggaaacattttgcttaatatgctagtactgtttatggattctttcatttatagttttctattgtgaaacatttagaaaaatatgttcaaagctgaaatgcaaattacttgcagtctgtttctgtactcatacacttatgacatttacatttctgtttttcctaaatgttacaagcattatctgcataatttgatgcttttcataacactagttccgtttatatattttcttgtgtatgtgttcttactttaaaaatttagtctctaatataattgtatattttaaaaagttgttttaaataacagccacattacttacatccatcttggctgatgtcacattagaataaaaaagatcctatgattgtcatcccactttactaaggttaaagaatccatgccatatctttcaccactgctattaagatgatcatatggtataagccaacttaggcaacactgtaaatctcagcatctgcagaagtggcaagaggtcaccagaagaccaccagaacttttttggtgcatttttctttactaagacactacacattgtgatcaatgaagtatggaggagaaccaatgccaaagtgttgtcattgagaaccaacatctgagaagctcgacaaagatgagcaaagagtggcaaggtgaaccgatgatacaacataattcactgtctattattttatacttataagctttccaaatctcacatgtactctcaagtgtctagcaaaacatcaagtgctctttattcaggaagcatccagaaaagctactaaatactttttataattatgtcttctttttattatatattttctttatttacatttcaagtgttatcccctttcctagtttcccctctaaaaacccccatcccctgccctaccccttctcctggtaaccaagctacacattactatttcctggccctggcattcccctatactggggcagataaccttcacaggaccaagggcctctctttctgttgataacctattaggctatcctctgctatatatgaggctagagccatgagtcccaccacgtgttcctttgagtggtggtttagtcccagggaactctggaggtactggttagttcataatgttgttcctcctaggggggctgcaaacaccttcagctctttgggtactttctctagctccttcattgaggactctgtgctccatccaatggttgtctttgagcatccacttctgtatttgtcaggcactggcagagcctttcaggagacagccatatctggctcctgtcagcaagcacttgttggcatccacaatagtgcctgggttaggtggttgtttatgggatagatcccaaggtggggcagtctctggatattcattccttcagtctctgctttaaactttgtctctataactccttccatgggtatttccccccttctaagaaggatcgaaatatccacagtttggtattttttccttcttgagtttcatttgtttttcaaattttatcttctttttaatataatataaaaatgataagattagacaggttttcttagcttaaaggaatctgtctcaaagatgtatgtttaatgatttgtctatggctatcaccaagcttctacacattttttaagatgttattttattttaatgtatatattaaactccatattcaattccctgacccatccacactctcaccgttccatatcccacaccttcttcccttccctcctcaccctgtcgccatatggatgaccccaccctgaccccacctgacctctaaacaccgtggggcctccagtctcttgagggttaggggcatcatttctgaatgaacatagaccaggatgtcctctactgtattgtgttgggggcctcatatcagctggtgtatggtgctgtttggtgggccagtgtttgagagatcggggacgtccagattaattgagactgctggtcctctacaggatcatccttctcctcagcttctttcagctttccccaattcaacaataggggtcagctgcttctgttcattggttgggagcaaatatctgcatctgactctttcagctgcttgttggatatttcgtagggtagtcatgttagttccgtttttgttagatctccatagtctcagtaaaagtgtcaggccttaggaccactgctcgacttggatcccactttggtcctgttgatggacattcttttccttagggtgctctccatttccatcactgtaattctttcagacagaaacaattatgggtcagaggtgtgactgtgggatggcaacactatcccttacttcatgtcctcctatctttctgctggagatgggctgtaaatttccctctccctactgtagggcatttcatctaaagtccttccctttgagtcctgggagtctctcacctcccaggtttctagtccatttggagggatccccccaacctcctatttcctgaggttgcctgtttactttctttctgcttggccctcagggcttcagtccttttccctcacccaataccagatcaattttacctccccacccctcccccactccttccatccagtacactttccctcccagtacactttccttccctccctctctacttgttattgctttcttctctctccagtgggactgaggcatcctgtcatgggcacttcagcttgttgagatgagttctgtgtatcttgggtattctgtactgttttgtttgtttgtttcattttttgctaatatccacttattaaataaataccaacatcttttatagatgtctttgataaataagttctgcaaattcctaggtatattcaatctagcctaagccaactttatatatcaaaacttattgtatttattactatatttgtgattaaaagtttcttttgatgtaaaggtatcaatgttttattttttttaatttaattttgctttttgtctgcctccaagtcgcccattcccacattgcttcttcccctcctcctccttctcctctgagcaggtaatgtcctcaactggggtatctcctgcaaccatcgacttcaaatctctgcaaggataggttcttcttctcccatagaggccaggcaagaaagcccagctagtaatacataactcacatacaaacaactgcttttgggataaaccctgttccagttgtccaggacccacatgaatgctaagttacatatctgctacataaaagcagggaggcctagatccagcccatgtgtgtactttggttagtggtttagcctctgagagccctaagggtccagttgatttgactttgttgcctgtggggtctctattcaattcaggggccacaatcattccttctattcttccaaaagagacccccaagctccattcactctttggctgtggggttctatatttgtctgaatcagctgctgggtggagcctctcagaaaacaacatgatcccgactgcaagcctaacagagtatcattagtagtgttagggattggtgcttacccatggctttgatctcaagttgggctagttgttgattgacaatccccttagtttcttctccatcccttgtgcttacatttcttgtaaacaggataaattttgggttgaaagttctgtggttgctttggtgtctctatcattacaatgaagttcctgcctggctacaggaggtggcatcttcaggttccatatccacaaagtaattagtaatatgtaaggtgaccggcaatgattcctgtgcaccactattatcccaggtctctagcttgtcctctagccctcccctgacatctccttactagcatcagttgcagatttccttccattttcatggccaccttgccatctttactgtccttctgcttttcctattccataaagtaactatgcctaggcatttgatgtatatatataatttttttacttaattctagactctgtagaaaactgaaagatgtaccaatctatgagcactaagctattaggaattgactaaatactatgtacagagcaataatcatagatactttccaaggctattgtttctgtatacccacaggtttctggccataatagcaataagagttaagtgttttggagtggacctcatagcctattagaaaactattgagtacattcatgaaattcatgtaacaattgtatcagttggcattttttagcaggacagtcactttaatcactgggattcaaagcctagtgtgattgatttctttcttcctctggtggcatagaactgcttccagtgccatgaaagatatccattagggatcaagcttacagatcaatcctatattgatttcccactgttctataccttaagaatgtagtgtgttcagctaaagggctgtacttccatattccgcagtgtaatcaagaatgttagcaatagcgctgtaatgaataggatctccctggaaaacaagccaatacaaagaggtaacacatttctgctattagattttatatttgttagcctgtagtgtccagtaaagaaatggttattctgttatcagttaaccctattgtttaaatattggtatgtgtatttacatattaaggtcagttttagagtagtcactttccatatgacttattcaaaatgcctccagtattatttatctttctctatgttccctcctttatcctgctcttctattgccctcactgtttaatcctcaatgtatcataattttgctttagccctttataccactcactggtttataaagcattctctttctttaaatgcattcccatacacctttactagtttcctaatctatatagttattccaaatacaacacatatatctgaaaaaataatatcagctttacctctgaatcatgttcttctgtgacataatttcaataactttaagggaacaatcttttaggtgttttgaggtgcacacaaatctgttatttatgtcctcatcttcccaagtacctgtgattatagtcctcctgcattatcagggacactgatattctagctttcaaaattgtattaaatcatcatggaataatgaatggtgggattttaagaaactttaaagttaaggaataacaggaaaaaatcatagaaccccttctcttactaaggcctgtagccaagagataaacaaacttgcaaagtgtatatgatgtcatagttaaatacctggaagcaagaactaaaaattaaaaacttctacaaatgttatcaatgttctaataatttttgttttacacacattcattcacaaacaggtaaatgcaatgtgtttatttaatgacagacatggaatacataggctagctttacattaaaaataataaacaaatttgtaacaaaactatccagtgcttcccaattcttttacttattaattagcaaaatagaaaattcggtctgggcatccaaatcgaaactcaaaaatctacacgtgtgtgaaaatatagttcagaagtagaccatttgcttgtctttaaaaaaagaaaaagccatctttctatctctcacagactgcgttcatgtttttctttatatgcttcaatttgtattctatattattatgcaaaatgtacaactgttataggatctaaccgcgaaacaatatttgttaaaaggtgaggtgtgtgttaacttcgttgtatattttaagaaaatttaaagtcctaaatagacattaaaataccaaagtaagttttattagaaaatatagtattaaactttgtacataataatttttaccatcgatgatttcattgcttctgcataaattacttcacaatggggtgatacttggggtaatcacaaaggaaacttcagtccctgtagttttgccattttttcctctgcagcttctcgctgtctgatggagacattccttatggcgatgttcccttcgtttttacacatcttttaaattatatgctttctagagaataccgactgttgaaaacccactttcaaactgtttcattcccacccccacccccaccccgctcccgcctcctgcgccgcggtcgcggtctctgctttactctcccctccgcaagacctgccacagcaggaaatgcgtcacaaacctgcgcagtggctgtgaggagcctgcggaggaaagacaggcttgataactcagcatagggaaaggctcgggatgaagcaggagagtcggtgaggcgatgggagagcaacttcatagatacggaggggactgagatgcagggggaaagggaggtttgcggagagaggaaacctggaagggggataacatttgaaatgtaaataaaccaataaaaacttaaaaaagaaagagagagagagagagagagagagagagaaagaaaagaaaagagaaagaaagaaagaaagaaagaaagaaagaaagaaagaaagaaagaaagaaagaaagaaagaaagaaagaaagaaagaaagaaagaaagaaagaaagaagaaaagaagcccttgggaccaaaaattcccttctttgaggatttctccgagccacaaatagagatgcacggtcaggctgagttaacttcctgttgtcgcaggagcaccgtgtggttccggattcatcttcagttttcaagttttgataaaatccgaaatcgattagctaatgaattcgcaatcgtacgggttttaggagtctcggctttttctactgagcttcttttctgtagctgtagctttataaatgagccctaagtatttgcttttataaaggaaaggaaaatactccagcgttagcgttaaatcaggtcggcagggacgggagatagccaaatctgctgtttatttttaaagttaaaatatttacattgaattttcaggaggtttgaaggcttaaaaataaaacgttcagcgtgatattcttaaatacactgtgtatgtcttacagacgttttgcttttcgttctaacatccagtaattttctaccaatataatctctaaacaggaatgatacatacatccatatatgtatataagtatgtgtatatgtgtgtgtgtgtgtgtatgcttatatatgatatttacttcagtcacacaatacattttcaagtatcctgccacataatgcatcttcaagtgtttatgccacaaaagggtgtgtgtgtgtgtgtgtgtgtgtgtgtgttaattattcagtactctttttaaaactggccacagtgaagctgtgattatgacaggaaaaggaactttaacatagtcttatggttgggatattaaggttatatcaaattacatcagatattcttgatttatttatagctaaggagtataagaaggaccattggatagaaaatagttaagcactaagagagactctggctgaagtaggatctaagtaataagacttcatctggaaaatggtacagaagaaagacactcagttgtgcatggtcgtgatttctcactcccttaaaaatgattatagtttaaatacacttttatgtaaaagagtacaaatattcagaaataaggttctagatcataaatgaaattgtattaaagaaagacaattctcagatgatgaagttttgtttttattgaaaattgattaatcattcaatatattctaattacagtttcccctccctcacccctcacagtttctccccatctctcctccctctgcatacaccccctttcagtctcttgttagaaaaggaaaggcttctcagagataataacaaaacgtgacaagttttggaaacaatgtctccatagcaaaatggaacttagaggtcaaaattctttggagagtctttcctagaaactgcaaaatgtgtttggcttagttggagggtaatgagggtgttcagaaaaggaaagtatcacactgagcttaaataagtggctagatttgagaatcaatggtactggggaccagggaaaacagctatgtcccagtcctcataacttatgtcctcatgttaactatgttaagccacttaacataggctgacagcaatgtcaccctttttgtatgccataacttatcttcatattttgtatgaattataacactgcttctgaacaagatttagaatttcctaccatgtgtgtgtgaaagtctttcagtaagttgatttttatattgctgtctgtcttgtgtgttatttcattacactatcaagaatagagtcctaaggcgggctatggtggtgcacgcctttaatcccagcacttgggaggcagaagcagttggatttctgggttcaaggccagtctgttctacaaagtgagttccaggacagccagggctatacagagaaaccttgtcttgaaataaaccaaaaaaaaaaaaaaaatagagtcctagagccaagacttttatgatatggttcatatgacaggtttccatggttttgtgtcactgtcatatggtaataaattttcttaacatatctaagtcaaaatattacatttctctagtcttttgtattcttttcatacatggatattcttctatagtctccaacaacatgtttgtattagggcattcaatccttttctcctgagcctgaatgttaaaattagtaactagaatgggtgtttaaaaattgacttgtcactatagcaatgactcagctgttaagagatctaactgcatttccagaagagccaggttcaattttctgcacctaaatttcaactcacaagcatctgtctttagtcccaggagatgtgagacactcttttctggcctccataggcactggagacacgccgcacagacacatataaagggtaatgccaatacacaaataaataatgttttaaatatctaaaaaaataatgtctttcattgtaattggcctattattaagggaaattgagtctacttggaaaaatgttgccacaaaataatgatttagaatttttatcattctacaaattctgatcattctctgtacagtagaactaaatcaaggatggaatcttctatcttagctttctgtgcacctggaaaggtggtgaggttgaaatttcagaactaaaatagaacaacaacaataacaacaaatagctttagctttttattgaacatattaatatttaaaaggataagatcaaaaggctaaatcccaggtcattatcagactcctcaaattctttttacattctttcctctttcttctagtcagctgggttatcactgctggagggggttggaccacctgctagtgcctttccttgtgctgtggaaagatcacacctctacatcacacttctagatggggatccaaatgtttacaatgagcagagatactacaaacaagccaggccagtaaggcttaatattgaaatcagataatttaatgagactattaatcaattctcttattgatcatcacatcatagtgcagtacacaagcaaaatagatgaaggctatatacttcaggctactgatccaatgctaatcactggataaaatgattgtctcatgacaaaacaactttatttccgctgtaatcactgagcacctgtgtggcttcataagaagggtgttaggaccttctccagcttcctcttcatagctcttctctagggtgtccctatatcattccgccctgggtaagggctccataaataatagccccctacttagttgtatgctgcaagtggcccatctcctttctctgctgtatactaatctcactcccttcaatctctccttcctttgagctggtcacattctgggctgatactgtatattctgaagataaactgccctaaaatatgggacagctgcccagccatggcccttgctcactcactggtattgccttccctgtagtattcaaactaatactttctacttgggttgattatcctgaatgtcacatgtcttgattgtaatttcttccagtttcttgattgtaaataatcattgctgtttttattgttaacagtgtaattccccccatctgcttagaaaattaaggatagctgaactctataactctctctctttgaacccacaaagtcttttacaatcccattggatttgtcactatcccttgtgatgctccctattttctgagagtataattctgctatgtaggggtagaacaactgtgcaagggcatatgtgtggtaggggtggacctgggttgatcttttgttcccccgtgcatcactctcaatcctttgtgaatactgtctgcttaactgatatttcgctcctgtgtcaggagtctggggagtccactgaatccttaagtttctttcattctttatctctttgccagcttttttattattattctactaaatatcatggcaaagatcaacaggaacacattgtattttcccttcatgtttgtagccaaaattctatagcaggtcctttcctaatgtgcaaaactatattttaagaatgcactagagaatatgtcagtcctctatagctttggaattggcaggagcctgatatagctatctcctgggagtctttgccagagactgacaaatacagaagcagatactcacagccaactattggattgggtacaaggtcctcaatggggtccccactagaggagtgagagaaagaacttaaaaagctaaaggggtttgcaaccccataggaagaacaataatatcaaccaatgagaccccctcccccaaagctcccagggactaaagcaccaaccaaagagtacacattgaaggacacatggcttcatctgcatatgtagcttggtcatatgaaggcaggagagtgggtgtgggtgggtgggtaggggagcactctcatagaagcagggaatgggtaatgggatagggagttctggggagactaaaaaaggggattacatttgaaatgtaaataaagaaaatatctaataaaacattttaatgtcattgaatttcctcagagaaagtgaatgtgattaaaacgaatgagtagctaaaatcatgcaaattaaagctataaaagacaaagaaaggattactgatggtattattgtaattaattgtaaataaattgacaatacacaaggagaatatgtggattttttttttataacaacaggtgtgaattccatattttttggtgtggttccttttgtctacattaaaaagaaaacctactaaattattgacaaatttggatttcagagactaggaatgttggatgggggaagggaaagagaagctagaagaagatcctgtataaggaaagaatgtttataaaatagtaaatagaacaccttcctaagtctaagggaaattgatcacaaaagagaatatactttcagagatcaacctttttttttttttcctttttccttttcttttgcctgcaagtgtctgtaaaaaagatcctaagaaaaaacatccattctctctagttctgaaagaaaacagttctggttaaagttcaggtttcattctaaccttaaaggcagttttcagaattccatggctcattgtgttttaggaaatcagtgactcccttgtgcacaccgccatctaccgtccaaaaattgaacatgcctgagaaaaactcatttaaaagtccttgggtgttgttgttgttttatttgtttacatttcaaatgttttcccccttctcggtttccctccacaaaccccttatcccgtcccccatacccctgactctgtgaagatgcccctcccccaaccacctacccactccaacctcaccaacctagcatccccctatgctggggcctccccaagaacaagggcaggattaggtataggggtagataggagagaggtttaaagacctgaaggaatgaatggaaatatgcagctgccaagggtaggagtgggggtgaaacactaagaagtcccagagacctgggatccaggatgctcccaggactcagtgggggttgccataccaaaatgcccaacactgtggatatggatcctaaagagaccacctccagtagtcagacaggacccccagtggcaggatggagacaccaacccacctacacaacttttgactcaaatttgatcctgtctaaaagaagtgcagggacaaaagcagagcagagattgatggaatagctgaccagtgacctgcccaacttgggatctatcccatgagtaggcaccaatccctcaaactattactgatgtcatgatgtgtttgcaaacaggatcctagtgtggctgtcctctgagaggctctagcagctgcgggctgagacagaagcagatgcttgcagccaatcattggactaaggtcaaggacccttgtggaagagttaaggaaaggattgaaggaactgaagtggatgcaaccccataggaagatgaacggtgtctgctaacttagacccatgggaaatcccagagactaagccaccaaccaaattgcatacaggggctggacaggggctcctgtagcagagggctgccttatctggtctcagcaggagaggatgtaactaatcttgtagagaattgatgcctccaagtgggggtatacagggaagagcacctctcagagaccaagggagagggagggaacaattctttgatagaaccaggagcgggtacaaggtttgggcggtaaataaataaattagaaaaagtccttgggggagatggtggcaaaggaacaaattactgtgatcagtatcactgaagttttatttgatttttttcacaattgaaacgtgatggataattgcttgaacaggaggatccacttcataattccttgtaaataaataaggattactaggccatgccatcttaatttcttacacatgctatgagtgataacagccaaagtgaatattattagcttgtttttaattttgtttgcaaacatgaaataacaagagttatctatgtgaggaaatttgtagttcatagttggctgtaaaaaattatttagttgaccttttgctaggatatttattcttgactcactgtgtgtggaatatttccataaatattatttttcttcagtttctctatggcttacaaaacaaagaaaatctcttaagataaagctttcatatttttgtcagtgtggcagatgcaaaagagtcatctgtgtatctccatactgaaaactaatggatagttgtaggagtggagagatccaattaatggttccttataaagaaataagggattttgtccatgtcctgttttcctgccacttctgccacatactacgtgtgctaacagacaaagtgaaaattattatcttatgattatttttatgtttccacaaacatgaatcaataagtgtatataagcatgagcatatacacatttcattctttactgtgccatttattcagttgtactggttttgtgatatttattcttaactgattgtatgtggtatactaccataaatatttttgtcattagctgttctatggttcacaagcctagaagaatttcttaagtcaacctttcatgcattttggctgtttgatatatgagaaggagtggtctgtttatttagtacaatctccacatggtgttcaggcccttgatatgctactgaaatcagtttccttcagagctggaaaggaatatttttcagtgttgtttccattttgctgaaagatgaatattcttggggatggtacggagaacctaacaccctatagaaagaatgtgtactgtattagggcataatgagaaataaaggagtggggcataatgagaaatagagcagtgacactctcctgttttactttctgtgtttgagtcagtttaaacaagctcctggaagttcaccaaaggtctcatatactgatcagtctttcagcaagcagcccaaagcaaaaatctttactaattttttcttctcaatttttatctttggtctttattttttctaaatattagattggttagatattttctctttaaaatatgtagtatttggtttgtaaaaaaatgtaatttctatgaaattatttttctttccttcctcttcaatactaaagatttgcatttattcatattcttttaatctgaaaactaacaattatatgtaatattagtgcccattcattttttgaagctgtattttattttcttttattttatacttctttggcttcctactgattcttttttattttgcagtctgccagtgaattaatttagtaggaaattagtacgttcaatgtgagtaacttcttgaaattgtataattttaaacggtaatttataatgagtgtttacatgtgggagaatgtttgacatttaaagaattgaaaaaaaaaagagaatcagaaaaaaatcacatattcattcaaaaatatagctggggacatgaacaacgggagtgttttcaagagaagaaactaaactgataagaattatgtaaaaaaatatttgttgtcccgtgtaagtaggaaactgcaatcaaaacaactctgagatttttccctctcaggcagcatcaattatatatgcagcatcaaatatatatgctaacatcactcactatcctcatttataaatgcttgctcagtcacatagctgctctagtcacaaaatcacaatagctaggaagtggaaacaacctaaatatctttcaactgttaaatgaaaaatgaatatatggagagagagagagagagagagagagagagagagagagagagagagagagagagagagagagaattgtgtatgtgatattgttcatctgtaatgagaaaggaaattatgtactttacaagcaaagataaatagacctagaaacagtcatattggatgagattccccagaccaagacagacaaatctcacattttcccttattggagacttctatctcctcctggtcttcagatgtgaatacataccatgaagtaacagaagaaataataaaactaaaatggagttatttctgcagtagatgattgggaaagcagagaggagagtacagctgaacacaagtgatatgatgggaaaagaaaagggtctttaatgaggaaaaggaatgtagacaaatacagaaaaacaagtagggggataaaagaaaagtgagggtgtctgggaaaattgttaaaaatcatactattaattatgttctggaagtaaggaaaaaaggaagaaaaggaagaatgaataaacaaaaaaacaggtgggaaggaagaagggagggagggaagaaggaaagaaacaactatatcacatgtctgtatgtaaatgtgcatatatagcatacatgatattttgttattttggctggcagtattccttgtggtaaaatatcacctaataaaaaccccaacagtcaagaggagaccaattttgaattattggtcaaggttgtctaattgactccccaaaccaaattatccaagtctagtcaagccatgaattttaagaacataaaatcaccattctactaaaccttcataattccttacttcaatatatagatgtgtctttatacccagttcagaatataggtctaatcaaaagaagagtacatatcagatctgattagtattattctgtccaaaagcctaaggcatggggatttaagtagctcaatggtacaatgcctgaccagtgtataagaatttgtgggttgaaatcccagaatctcagtgaaaattaatttgtagcacaagcatgatagttcagcctttaaaacgccctcaagccaagcctgcctagcagagttctatcccagaaaaccttatgccaaagaagagaatttacttccactagtgtcccttggaccaaagaaatacctactcccataaataaatgaaaatttaatgacttaaattgaaggacaacaaaaccatcagtttatcagtaatcatgctgactttgcccctccttagaattgggaacaaaacacccatggaaggagttacagagacaaagtttggagctgagatgaaaggatggaccatgtagagactgccatatccagggatccaccccataatcagcctccaaacgctgacaccattgcatacactagcaagattttatcgaaaggactcagctgtagctctctcttgtgagactatgccggggcctagcaaacacagaagtggatgatcacagtcagctattggatgggtcacacggcccccaatggaggagctagagaaattacccaaggagctaaaggtaactgcaaccctataggtggaacaacagtatgaactaaccagtaccacggagctcttgactctagctgcatatgtatcgaaagatggcctagtcggccatcactgcaaagagaggcccattggacttgcaaacattatttgccccagtacaggggaactccaggtccaaaaagggggagtggctgggtaagggattgggggggggggtatgggcgacatttgggatagcattgaaaatgtaaatgaggaaaatacctaattttaaaaaaaggaaaagaaaaacagagttattttcagacagatttattttctgatcatggttcctcccttatcatccctcattttgtctctctgtagaaaatatataggcatattaaaaaaaaaaacaaaaaacaaaataaagtaaaataagagagaaagcaccaaaatcacagacacacaaagatgcatgcctttacacaaaccccataaaaatgcaaaattcaaatcacaatataaaagcaagttactagtgaagaaaatcaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacacagatgtagctgtctcttgtgagactatgccagggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaaaagaaaaagacaaagagaaaaaaaaatgcaaaattcaaatcacaatataaaagcaagttactagtgaagaaaatcaaacacagaacattctgagttaactaacaaaatactgtcaaaatagcattgagttcatatgagttagctggataaaacttgtcatgaggcttccatctgagtgtggtttatatccccgttgattcatcatcagtgtaaactagttttcctttgggagtagtcatcaactggaggtagcttcctggtcagaagtgatcaattaggtcgacttccttctcttggcactgacttgaatctctgcagatcctgtgtacgctgttctgatctatttgagtcagtcttttctttatgtgtttatatttcaaatgttttcctcttttccagtttcccctccaaaaccaccctatcctatccctttccctgctgcttctaaaacagggatcccactcccacctaccgactcctatctcctcaccatcctggtattcttaatgtgcctggaaggcattgtttccctggttacattcctccctgccccactggcaattagaatctctgtaactctcttctgcagtttcctaaccatacaatggactttgcatagatatatctcatttatgactaggtgatccaatgtctctcattctatgtacattgtccagtctaggtttcttttcccatttgttcccatctactacagatggcagcttctctgatgaagcacggattaatgggttatgacaaaatgtcattaagaatcattatattgctttatttcattagaacaagattatttgactttctcctatgttcattaattacttagttccatatgtttggatacaagaaatattttcgttcttgtggagtgggccttaaatccaatcataaaatgattgttcacttccacaatatttctgccactattttaccattgtatcatataggtatgtcatgattgtagatcaaagaggttagaattgggctggtttataaattaatttcaagaatgcatgcagaatacttcacagtaacatcattcctattcgggtggagtgaagatttcaattaggcacatgcttgatttctctgtattcaatgagacaatgagggtattgttttcctcaacagggccatgccatcagtttgtgttggtaatagcctgacttgtttgagtgtttccatgaagactctttgtccaaaaaatcaattatacataactcatacctatgataaaaggttttatttaatgagaaatgagtagttcagggattctttcccagttatttagttatttgatttatattctcatctctatatattaacatgtctactgtactagattactataactccttggagatgatccacggttctatttttccatctcagtattccatccctatttatccccaaatttatcatctctccctattgtcttcatttttatatatgctatttctacttccactagaaatccttccctcccttctattatcttttgctataccttacctttgtgaatttaaggattcataatgcttttgtgaaacttaaaacttaatatttaactatgagggaatatattcatatttgtctttaggtttctgggtacctcactcaggatgacttttcttcaatttccatccatttacctgtgagttccataattgtattttttaacagctgacttatattccattatataaatgtaccacaatctcattattcattcactactttttaagacatctagggtgttttctatttctgactagtatggatagagcagcaatgaacatgggtaagcaaatttctctgtaataaggttgtagagtcctaatggtgtatgcccgaactggatcttggagtagaactattcccgttttccaaaggaacctgcacaatgatttcaaaagttgctgtaaaaattccatttctaccatcaatgattaagaattcccctttctctgaatcctcaccagcatctggtatcatttgtttatggatctttgttatcctgattagaggaggatgaaatctcaaagtggctttggtatgcatacccctgataactgtgaatgctgagtactttaagtgaaaccagcatttgaatggccacttctgggtcattggaggaagcaatttataattgaatacacagagataagtaggagggtaagccatggaaattagaactaaggaagacaatggaaggattactattcaaagagtaactattgagggaaaacagccaaattgcatgagacatgcaactaagggaaataataaacaattttaattcatctcagtatgtgtatgtgtgtgtgtgtgtatatatatatatcaattacaaatatatatataatgtatatatatatgtatatatatattacaatttcttgttttatcattaaaatggaggtcacccagctttagaatagccctttataatgaatttatagaacctgtgctgttgactggtgagggatggtaaaaactttaaatttagagttagattttaggtagagagagtaaaatatatgagagtagcaaaaggaaacagactacaggactacagcacaagaaataagccaggggaagatgtgttgtaggtgcagaatctccctttagtctcaatagatctcatgttaaaattaccagaagaaaacatgttatcttcacaatagattgcatccttgcccttataaccatatgccaagcttgagcaagtggttacctctgtactcacagagccatctaacttttaacaaaacaaaaagattgatggaaacctcttcaaaaggggacagggaggggaagaggggagtgtgaccagttattgggtaggagaaaaggactgaagccctgagagccagcaaagagtggagaaaggcaaccctggaaggtaggaggtggagggatcctccagaatgtaccagagacctgggagctgagagactctcagaactcaaagggagggaccttagttgaaatgccctacagtagggagagggaacttgtagagcccacctccagcacaaagcagggcattaagtgaaagagggtttgcaatcccacagtcaaaaactctgacccataagtgttactgtcctaaagaactacaggggaataaatagagaagagcctgagataaaggaggtccagtgacaggcccaaattgggatccagctgaaggggaggccccaaggcctgacactattactgatctatggagtgctcacaaaaagggacttatcatgactgccctccaaaagacacaacaagcagctgaaagagtcaggtgcagatatttacatctaaccaatggacagaagctgctgacccctgtggttgagttagaggaatcctggaagaagctgaggctaccctataaggaggaccagcaatctcaatttacctggacccacatgatcaatcaaacactggaccatcaaccaggcaacatacaccagctattacgaggcccccaacacagatacagcagaggactgtatcaatcagagaagatgtgcctaactctaagagattggaggccccagatagtggagttgtctattggagtggggatggggggacatccttgtggaggcaggatggaagggagaaggtatgggatgttgaatagttagagggtggactgggataaaatctcaagttaaaaaaattcagagacccaagtataaaaaattgctgtgcttatttcaacaggaattaaattcatttcaacaaaatttaaatctcaaatcccaaatctaatgtcttatttctagaggagatatctaatttatattagctttcagaacatactgtgtactgatgcaagacactctttgctgtcccatcatacatagatgactaaagagttaaaggttaataaaaattctttgggtctgactgattaaagaacagatacagagagaaattttaccattgcacatacaaaatgaaaatttaagagtgaaacaaatttaactgaccattgtacatatgttatttttgatccagtattttcttgcacacacatttcatttcagttacactagaattcatataatcaacatttcattggcccaaggtttgagtctaattgcctttaaaacattcttttagatgtttctcaactgcagaatggataaagaaaatgtggcatgtctacacaatggaatgctataaagctattaaaaatcaagacattatgaattttgcaggaacatggatggaacttgtgaacatcatcctgaatttggtaaccaaggctcaaaagtatctggatggcatgcaaccgcttataagtgaatattagccataaaatataggtactatgctacattccacagacaaaaagaataaagtagggaggccagttcgggaagcttgaatctcacttagaaagggaaataaaatcgtcataagaagcagatggatagaaggaaatggtaggcatagagatggggaggtgaaaccaaggctcaatatcaggtgtggggaaggacaggagagatgcctagatagccatgaaagtgaatggaaatctgtaactgactgcggtgaggaagggggccatcttcaggacaagacagagttttaggataagggagacaccaaagaatcattgtgggtggccttaattgtaacacactacacaggggatatggaacacaaagaggctacatcctatagccagggaagaacgccagtacaatgatagagataaaaaacaaccataaaactttaaacccaaaatttatcctgtctacaatatctccaacccataattgttcctgtgtgaaagaattacagggatttaaatggagaggagactgagaaaaagagggttcagagacaggcccaaagtggaattcagctcaaggggagttcccaagacctgacactgttactgaggctatggattactcaaaaaggaacctagcatgactgcccctccacaagatacaactagcagctgaaagagtcagatgcagatatttgcacccaaccaattgatagaaacacctgaaccctatggttgaattagggagggctgaaagaagtaaggagaagggccatcctgtaggcggaccagcagtctcaattaatctggacccctgagatctctcaaacactggaccactaaactgacagcataaaccagctgatatgagactcccaacccacatacagtagagaacttccagttctgtgttcattcagagatgatgtacccaaccctctagagactggagacaccagggaatttggaggtcaggtgtggtgaggagtgtggatatccatgttgagacagggggttagggaggagtattaaatgtggaacagtcagagggtggattagggttggggtaataaaatatggaatgttgaaaaaatattttccaactattttttaaaaatgaagatacaggtgatgggctagatactgaggagatgaccaaccaataatgagctcatcttaagatccatctgctgggcaagtaacagtctattaatagattctctggtatggttgcagataggagcaagttgtcctctgacatggtccacccagcagctgacccagaaagacacagacacacacagccaaacaatgggtgaagcttgtggtctattatggaagaaaatggggaagaattgcagccaataatgggatagaaagtacacagaaaggacaccatagtcaactaacctggacccttgtggctctcagaatctgaaccactaaccaaagtacatacttgggcttgaactagacctccccttacataacacaagtaacagatgtgcaacttggtcttcatatgggtcctggacaactgaaaaggaggctaactcaaaagccattgcctatatgggggatgttttcttacagctgagctgcttgtctggcttcagtgggagaggaagtgccagatatttgaaatgccagattgagggggggaataaaaaggaggacctacctgctcagagaagaagaggaggcaggtggggcaggattgtataagaattgttatactagtgagatgggggcactagtgggatataaagtaaataagcttaataagtaataaattaaattttaaaaagaatgataattttttcaggagtcctaaaatcacgtgggtttttcttttttgaaactgatatatattttatctgattctcaatatcagcataacaaaaatttaaattagacgtagaattattttaacattctctttcactgaaatttatgaaacaggtgattttgggatggtgaagtatcaagttataattcaattaggcaacaaaataagagccagggaaagaaaaaagtcctagtcttcataacttgggccaacaatcaaatatccctatttacttgtcacaacttatgttcatatagcctttatattataaaaaggcttacaaacaaggagatagcttaagattggatggcaatgtctcatttatgagaggagaatccatggtctttcactctgtatattgtccagatatgggcctttgtatctggccccatctcctatatatgctagcttctgtgatgtcaatggagcaatatactgatctatgggtttaataacaaaatattattagaagtcaatgtgttgctacatattgtagcagacaatagtacctgcattaagccttagacttgggtactttaacatgagaataatgtcaaatatgtattctgtctcattgtgtaggtctcaaatccagtcagatagtggttacttatccccttgaaggggccactatcacagcagtgtatcctgtaggcagctgagtgtagtagatcaaatagtgtataactgggttggtgtgttaagtttcccctcactaaccatacagaatatttttcagtaccagcaaatctattcatcaggcaaaggctttagttagacaaatgcttgtcttctctatgttcaaaagaaatgtaggtgttgtcttcaacaatagagctatgctcagtttgtgtggagcaatcagtagcttaggcaatggttcgatttgtttggggtattaccatgaggacacattgaccaagaaatatattagctataacccatatatgggattgaagctttcatttggtggcaagggatgtctagttgggtcattcctattatttggttattctttaagatttttttttatatattacatattttagatgttatatattaagtctactgtggtagctttcagactgatcatacttttaggtgctccccttagtattccacttaatcctcttcacttcccccctatccatttaaatgccccattccaatatcacctccgaatagtcgcataattatatattatttctaaatcctcaaaaaattcttccctccatcctaatttttgcatgcctttgtcaaggctttaaatctaatatccaaatataagctaataaatactatatttgtctttggggttctgggtaactcagaatgaggtgtttgtttgtttgttttagtttttgttttagtttttgtagttccatccatttaactatgagtttcattattttgtttttttaacagctgtgtaatattccttttataatataccatatttttattatcaatttctccactatgtataggtatttctaactactgttaataatacagcaacattgaataggaactagtaaggaatgctataatatgatatgtactcccttagatatatgcttagcaatgatacacctggaacttgagatataacatttccagattcaaaacagaaaaccacactgattttcaaagtggcagtacaagtgtgtattccaaccagcaatgcataaggattcttattactcaccctcctcaccagcatatgtggtcattcattttatttgtcttggccatactgattagtgaaaaataaaatctcaacatggttataatattcatatttctgattactaaagttgttgaacatttctttaagtgaaaccagcacttgaatggttaattatgtataattagaggaggagatttatatttaaataccaaaaggataagtaggtgaaagacatggaaattagaagtaccaaagacaatgaaaagattagtatccctagagaaaccatagcaaagagagcacccaaaagcttgaagcatacttcagttggggatattaagcaatttcaacacacacatacaattttctgatttcattgtcataaaagagccagccagattatgaatataaatttgttaataaatttaagtaacatgtaattcataagtgggggatgagaaaccatgaagtacaaatatttaataggcaaatatttaatagggaagatacaaaatctgatagtagggaaattagcctacttcaaagaaaattgtcgttaaaaatgtattctcacagcagaaagtcccttcaatactcacagatcctagacacagatttgattcttgtccttaaaacctgaagccaggtttgaagaagtgattatgtctgtgctcacagcgccatctagctttcaacgaaacaggaaggttgatggaaacctctacaaaaaagaaaacaatttcaggaggggagaggagggagggacctggatgggaaagaggacaggggaacatgatctggtatttggtggagggaataaaactgaagccctgaaagccagcagaaagaatgggaacaggcaacttcaggaggtaggaggtgggggaccatccagattgtatcagagtcctgggagctgagagattctcagggctcaaaggaaggaatcttagatgaaatgtcctacagtgggaagagggaacttgtagagcccacctccagcagaaagacaggacatcaactggagggatggggttgccatcccacagtcaaaaattctgactcatatttgttcctgtcttaaagaacttcagggacaaaaatggagaaaagcccaaggaaaaggagatccagtgataggcccagagtgggatcctgcttaaatggaggccccaaaaactaacactattactgatgctatggagtgctcacaaaaaaggggcctatcatgactgcccttcaaaagacctaacaagcagctgaaagatgcagatatcagatgcagatatttacacccaaccaatggacagaagctgctgacccatgtggttgaacttgggaaaagctggaagaatctgtgtaggagggtgactctatagatgaaccaggagtctcaaatcacctggaccccaagatctctcagatactgagccaccaacaaggcagcatacaccagctgatatgaggcccccaacacatatacagcagagcactgcagggtctgtactcagtcagagaagatgcacctaacctcaagatactggatgtccagggagtggggaggtctggtagggtagggttaaggtgtatggatattctcatggagatagtaggggagggatatgatgtgaaacagtcagagggtggatgggggaggggtataacatctggactatagaaaaaaattagataattttttataaaagcatacagatagacccaagaatattaaataccaggtttttttttctaaaaacgatttaaagaatcatttcaaagccaaaacctatactttatttctacaggggacatctaatgtactttcaccttcagagacataggaagaatgatgcatgtctctgttagctgccacatcacatttcaagcaaattctaacaatagttaaaattcagttagaacactttcatgctgactgacagaaataatggctggagagaaatattttgctatgagtacatacatagtagagatttaaacgtgaaagtgatttaattgaccattattatgtgtacgtatttattcttcattttgtatggacatattctcttccaaatattttttttaatttcagttaccctctgattcttataactaataagactttattaaatgaaactttgaagctggaagaatggcaacacacactcatgaaggaaatagcagtatttctggcaacagtaattgaaaatgccttctttagcaatgaaaattaactctaccagattggcccaggacatgtgctaattttcattagggctgaaaaactagatctgtacaattgtggtggaagtctttctgaaaggaagacagttctcctggcaggtggattctctttgtttctcagtgcaggtagtgctgagaagccaggatgaagatagcacatccctccctaggtttctttgttttctatgtaggacaaaactttccctccttaaatagaccactcttcaattgctcctcatagggttattgcttatcaaagtcttcaacctgtatcccagcattaaaaggactctatttagattgcttgtttatgttgaagtctttgctatctaacttcctactaacatctgataagctaagtctttcctaggataaataattctgtttctagagtgccctttggtctttagttacaaaaagtatgggtttaaacgaaaactttgaaatctcattagtcagtttcagtagtgttaaatttctgttattttacatttaagattttctactatttgtttttaaattcttctctcattcattacaaatcctatgctttcccctcccgcctctccatgcagtcctcccatatctttcctgtcatccacatctacctctccaaaatagtcttcaaaaaacaaaacaaaacaaaaaaagagcaagtttttcagcgatatatcaactaaacatgtcataacatgttacaattaaactaggaacaaacctcctcaacaaggctgggtgaatgaattgttgagtgatttaaatgttctggatgacctaattcaaaggatgcattagatgtccttgttacaattattgtttaatctcattattggactattttgatgagagtatttagaaatagagcaaattatgaaagatgctttctaggcaataccaactggtataaacgcacattaaagttactatgtccattacctttctgtaccctccaccaaaagcagtgacctgagccagtcagtagacctgtgacaggatgtcataaaagcactgcacaattacacctgcctctggtgactgaaaatatggtgaaactacaaggaccaaagttccttttgggttcaacctccactggtgtcaaaaataaaagtcacccccatcgtctttaagttactctggtcactggagcataaccaagtgctttgacttttcatatttcggatattgaatttcatcattagaatcttgagttttcaataatattaatagtagacgtcctgccattttatcttaatcttgttttctttagacatagatttacaaatgtgtactatcaaaagttttgcttttgtaaatagtgacacaaagagttcagtattaattcagggattaagaagtcatgagttaatttagtgcagagttctatcagaacttcaaagaagatctaatcccagttcttcacaaactattccacaaaatagaaacagacggtactctacccaactcattctattaagccacaattactctgatacctaaaccacaaaaagaccacacaaagatagagaacttcagaccaatatcccttatgaatatcgatgcaaaaatcctcaataaagttcttgctaaccgaatccaagaacacatcaaaaaaaaatcatccatcctgtccaagtaggtttcatcccagggatgcagggatggttcaatatacggaaatccatcaacgtaatccagtatataaacaaactcaaagacaaaaaccacaagatcatctcgttagatgcggaaaaagcatttgacaaaatccaacacccattgatgataaaagtcttggaaagatcaggaattcaaggcccatacctaaacatgataaaagcaatctacagcaaaccagtagccagcatcaaagtaaatggtgagaagcttgaagcaatcccactaaaatcagggactagacaaggctgtccactctctccctacctattcaacattgtactttaagtcctagccagagcaagtagacaacaaaaggagatcaaggggatacaaattggaaaggaagaagtcaaaatatcactttttgcagatgatatgatagtatatatacgtgaccctaaaaattccaccagagaactcctaagcctgataaacagcttcagtgaagtagctggatataaaattaactcaaacatgtcaatggcctttccctacacaaaggactaacaggctgagaaagacattagggaaacaacacctttctcaatagccacaaaatatataaaatacctaggcgtgactctaactagggaggtgaaaaatctgtatgacaagaacttcatgtctctgaagaaagaaattaaagaagatctcagaagatggaaagatctcccatgctcatggattggcaggatcaatatagtaaaaatggctatcctgccaaaagcaatctacagattcagtgcaatccccatcaaaattccactcaattcttcaacgaattagaaagggcaatcggcagattcatctggaataacaaaaaacctaggatagcaaaaactcttctcaaggataaaagaacctctggtggaatcaccatgcccgacctaaagctgtactacagagcaattgtaataaaaactgcatggtactggtatagcgacagacaagtagaccaatggaacagaattgaacacccagagatgaacccacacacccatggtgacttgatctttgacaagggagctaaaaccgtccagtggaaaaaagacagcattttcaacaattggaccaagtttaaaatgaatttttcatagaatttttgagaggtttgtagaatattttaaaatattaatttcaatctgacttcttaaatacaatgtgtatgtctaacacaggatgtttgaatcctacagttttttaaatacttttgccaaaatgactgtaaaccaaaatatgagaggcaaacttttatagcagatatttactttagtgccacattatccaccttaaaatattataccaattaccttatgtttgcatgtgcgctctcaattattttaagcagtttgtgtttattttaatactaattacaacttttacaatgtcagtaaatctgttatttatgatagcaaaagaaacttcaacatagtcttcttgagacattttggttgtatcaaagtacagcataggatcttgggaattcatttatagccaaagggcaagtgaagggccattggacagaaaattattgaatactgaaaagactgtctcaagaaggatcagagtgataagatatcatgttgaaagtgggagggatgagaaatatattcagatgagtatggtggtggattaacctaagcatttctcaggacagcctgagtctattgcagagtaaaggtaatataagatctgttaaatagaaagtattgacttgaggctcagaagacactttgaacttttaacactattcactctctgaaagacaatgagctcttttaaagttttacaatatacaattttattatgatatggttgtgagactgtgataataaggtgtacagtgaagtgttttgaatgagatgcccactatttgtctcgaattttcaaatacttgactcctagttgatggctgtttggggaagattagaagatgcagcattgctggacaaaagatatccctggggatagctttctatctttcaaaaatctcatgatgtttcaaagagttctctcttcttcctctctgtggtttgaaatataagctgctacttcagcaaccagctgcttgccactcaaatacagaaagactggacataaccttttgctactataattttaattttattatttattttttgttgttaatacagggttcaaaaatgtaatcctggctgtagttaaacacaatatgcactccctacatatgccttaaatatatgtgccatgatgcctggtcttttttcactaaacttttaattgtaaatataattaatgattaaagccaaatgcacatttaaaatgaaaaaaaaatgattcattgtatattggcttacgtttgtaatcatatcattcaagagatacaaacaaaatgattactaaacgtttgatactatccttggctacagaatgagactctttctcaaagttccaaaaataaagaaggaaaaaataagtaaaggagaagacgaagaatgagaggactctaatattcagatacaatgaaaatctcaagagacatgagttaagtcattgtcacatgcaaactagaattctttggtatgtgaatgagtgagctttggaaaaactgagcatataaaattagagttctctcagcaaaaacaaaaacagtaagtacacagtaatgtaccctgctctttgggtcaattttgagatctattaatttcattttgctacaactcttctgagtgcccatgttacattatcattgaattcagcaatataagtcctcttcactatatagatatggtaatcagtacacagaaatttatataagttgcaaagataatactgtcaattctataattagaatcaaatgcagaaaatttaaatgcatgatatatatacatagaatatcatagtatagattacatcgtatatcttacacaagtttttatccttaggtattattgaaatagttattctctctttcaacttgacgagatttagactcataagttagacaagcttctatcatgattgagtggggttagcttaattaacctaatttaggtagaagaacctgtccttgtgggtagcccaaagttgaggacccttagcactgtcctcttcactaacaagttggatttctgtgtcccaagcaagaagtctaaaacccaaatccagggattgacacttctacatacatacagacaattactcattttttagataaaaaagtaatttatttaaaattataggactttctctatgtgttttcagcatcctaatgccaccttgactcttattatattaagagctgcaaaatgtcttggattcattttctttttgagctaaccatacataatccttgacttttgtcactattgtataaaatctgtaaggtagattaactcatgatacaacaatcctatatcttaatatgctaggagacagatgaaaatagaacgctttaaattcaaggccaatctgttctacacagtatctccctggccagaaagtgctattgatgcaaacattgtctttaaaaattaataaatcggtctgtcttattgagtacttgtttcaaggcatcctctgacaactttcatatagacaacactactgcattgtagtttcattgtctttttcctactaggaatctatatttgaaaggtatcttaaaagtgcaagagacacacaaagacagagaaacagagagaaaaacagacagaaagagagagaaagacacagagaaagatgtatataaatggttaaaaataatgaaatctaggaaccatggtgacatatgcctttcttctagcacttaagaggcagaagctggatgaactctgagttaaaagcaattctcatctaaaaagggaggtcccagtccagcaaattctaatgaataaaacaccgtttcaaaataaacaaatgaaaataaatttaaaagtacatcatagtaacatttatttaaaaacatgaggaaaaaaatttcatcactgaatgataaaacagtgcttttaataaacaacaaatattacgttcacgctaagtgtttaatttacgtgaacacataggaaattttaaagatacacctaattaagtaaaacctgattaatgcagaatgttgttaaagtagcaccttttaatagatagtgatttctcctgatggtactacaagtatctaccgcttttggactttccctagtttgcttacaatttttctaagcactctttctttcctttgtatagagatatgaaggtgaatataattcaatattatgtagtcatcattgcacagaaatcaccatgagtatattcctgaccaatttatgtaagggtttatgaagaccctcctctttcatactagcaataggacagcttacagctcatggccacctgcttttgtcattagctttacaaaagatttgaatccctgcagcctggcaaacatccacgcatgcgtgattggaaggctgtgcaggctctctaaaacaggctgggggttgggagtgtgatttgtcaagtcagtgcagcaggtcctgctcagagaagagccagccaaagatgcctgtcacatccatcctaggaatggtcagcaaggcaatacagcaaataaggttagctcccactttgaccccttgtttctttcatagtagattcatagtagaacatgatttgtgcacattaagtattgcaaatttgttaggattagaacactattctatagatctcaagtctttagttgaagaatcagatgagaaagctatgagatcattacctggcttcctttgtcctgtcctgtgttgtgttgtctgtggtgcccctccccttgagccttcaatctgccctgtcacatcagctcagttctcttacagggtgaacattaacatttcaaagagctgacagtactgtggattattggtgtgtaggacaaagggcagtcaggaagaaaaaagaacatttatatttacagggatgtttcataaaaataatattcctaagggaatttaagtcagattctgccatgccctgaaggatgggaagggataaaagcacttgagggttaacatagagattatcatcagagggaagacacaacagataatggtaggtcccagtttccggatggaaaggatgatcaggtacatatgacttttgacactatgatacctataacacaggaatgaggagtccaaagtggctttaagaaagagtagtggagagtaaattcaggtgtgtgaactaccaacatatgaaaagatgggatatctttcacacacacacacacacacacacacacacacacacacacacgtgtacagaataaacatttttttctgttatttcataatgtaatctaatttgaatgcttacagtcctttactgtctttagatatttgttatttatttatttatcatcatcattattattattattttgctatgttgttcagattaaacaataaactagtgaattagtaagaacattctttggatatgtaatctatttttttattttgctttgtcccctcatttgattgaagtttataagatattcaaaatagcatggtgattttttttttcattttccatcagataaataggaaagagtgtgtgttgtcttttgtttttgtttgtttgtttgtttgtttgcaggtgtttttgtaagtgtattttgtttttcattataaaatggtgttttattttatttttattgaaaattaattttaatacaataaattacagttttctctttttccttctcctcccagttcctccctacgtccctttccttctttttttttttttttttttttcaataagatcctgagagtttattacatttaatttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgtgtcctttcaataaaatcttgctagtgtatgcaatggtgtcagcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctctttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactatcgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagttttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgttttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaacttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttacgagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggagtcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagcggaagggacttgtgccccagatcccgtccctttccttctaggtctaatccctttctgtctttcattagaaaagcacatccaaatgatagcaactaaacatagcaaaatgaaatataataaaataaaccaaaaacataatgttgtgggtggagaatgcaacctgacagaaggaaaagtaccacaggagcaggcacaagcataagagacacattggttaacacattcaggaatcccacaaaaacactaaactgaatgttatagcatatatacagaggacccaatgcagtctattgtaggctcatgaacagagaggtacgaagaggtatgtcctttggcaggtatcatatttgtttgtatgtgtgtatgtgtgtataatttatgtatgtatgtatgcaatttatgtatacatataatttatatatacataaataataatatacataatgtgaatattatgtatattacaaataacaatgtaacaatgttatgtataacataatttatatatatttatataatgtaaataatactttgtctatgattttttttctcaaactatttattacataaacatgatttttcaggttttttatcctggaattttgctgaatgtgattattagcattatgcagtttctggtggcatatttagcacaattttttacttatagaatcatatcatatttaaattttaattaattgacttcggcttttcctactcctatcgcctttacatctttcactcttgttgcttacctaagactcctaatactgttctgaataagacaggaagtgtgagcttccttgtcttgttcctgattttaatgaaagtgctttgagtttctaatcatttattaggatgctagctctgagtttgattttcattgtcttattatgctgaaatatactctctttaacattatcagtgaccacatttctaaggaaactggacacttgctatcttagtagtattcattactatagaaatgtctgcaggtagggttggaatatttagagcaccttcatccttctttcttgaatttgctctagatattcttaggggaatatacatttaaccataatttttggaggtcatgtttaaacagttatatcatttatagagaaaacatttctgagtacttctccaatcctctagctttcatttagtttccacaactttttcctgaatattgtttgaccccagtacaggtagttttagatgtcccaactatggctgaataatgacagttcctcattctcagtattttaagtagttattcacctttgtgctaatcaacaccaactctaataagagtctaatctactcaaagaatcaccagcatgtaactatggaaataaacaaaaatgtttaaatggaagtttgagaaaatgaccagttagaaaaataaaattagtatgttttctgctaagacctacaaattcctttggcatgtttgatgccagcgtttgcagtatcattcatgaattctctcctgaagaacaggcattgatttctaatcaatactgaggttaattactcgagtaagtagtcttaccacagttgcactatgaatgcattgaacctggcaggtcattaatatagcatgaaaagtttaatgatggataagaaaattattaatttttactctacttagaaaatgcagagagacattttctagcactataaaagacagccagcatggaaagattcccgggtagttaaatgtgggtttctccatcaaacagtatgtatagtgtcttatataacatggtcttaccatgaagttaacatggggcaattgagaacatgcatgattgttggtatatgcttcctaggattctttgacttttttattattattaattattttagttatttactatccaaatattagaccccttcccacactcccctccacaagcacccaaccccacccccttcccatcacctctaagagagacttctcctatgcacccacccactcctgcctcacatctctcacatcacccttcaatggggcaacaatcctccacaaaaccaaaagcctcccatccaattgacaccaaataagataatcctctgctacatatgcagctggagccatggaatcacccatatttactctttggttggtggtttagtccctaaaaggtataaagcatctggttgattgacattgttgttcttcccatggggttgcaatccccttcagctcctcagtccttcctctaactcttccattggggttccccaggcccagtccaatggttgactgtgaggatctgcatctttcttagtgaggttctagaagagtgtctcagaggacagctactgctgtcaacaagcacttcttggcactagcaatagtgtcagggtttggtgtctgctgatgggacagataccagggtggggaagtcactggatggactttccttcagtctttgctccaattttttgtccatgcatttcctttagacaggaacaattctgggttaaagaatttgagatgggtggatggccctatccctcacctagggcccatgtccagctactggatatgtttttttcatgttctatctccctagtgatgggtattttggctaatgtcatccccaatggatcctaggagcctctcacaaccctggcatctgggactttctagtggtcccccctgtaccctacccctactacacatttctattcgttctcctggtcctctgaatttctttcctgtctcttctcgtaccacaagcctgattctgcctcccccctccctttcccaacctcaccaagttccctcctttcctcttcctcccatgattattttatttcactttctaaatgcaattgcagcattcacactttggctttccttcttgttaagcttcatacgatctgtgagttatatcatgggagttctgagattttgggctaatatccacttatcagtgagttcaaaccatgtatgtccttttgggtctgggttacctcactcaagatgatattttctagtttcatccatttgcttataaaatgcataaaggcattgtttttgatagctgagtagtattccactgtgtaaatgtaccatggtatttttgtgtacatttttctgttgagggatatcttggttgtttccagtttctggatattacaaataaggatgttataaacataacagtccacatgtactttttatatgttggagcatcttttgcccaatagtttcttcatgtagaactttctagtcttctgaggaactagaaatcactttggaatgtaatttccaaagtggttgtaccagtttgcaatcccaccaacactgtaggagtatccggaaacacatggtacagacttatatgtaaattattctctctctctctctctctctctctctctctctctctctctctctctctctctctctctctctcacacacacacacacacacacacacacacacacacacacacatacacagaggctacagattccataagataaatcataaacatggaagagggtctcacaaatcttaaaactttggcctcgtgaataccagaaatctcccttacctctgagactgaacaagaaataaaaactcaaggccagttatcagatacacgtatcacaaacaatctccacgaaaattgtcacaactaagaaattacaacttgtattagttagctttctcttgctttgataacacactgactgaaaaccagttcttgaggaaagtgtttatttggtttgtactttctcattacagctcatttttgaggaacatagactaggaactggaaatcaggacttaaagcagaaactacaaaaaagcactgcctactggcttgctcagattattttcccatacaattcatgaaagagctgcctagggatggtagcatagtgccctaaggtctgggtacttctgcatcaatagtcaagaaaatgatctttcgcacatgtctactgctcaatcagatggagtcattttctcaattaaggttcatctgcagagatgagttgaccttgtattaagttgaaaaactctgaaaacaaaaacaatccaaaacaaaatagagaagagaaacactaaacatcaaacctctgttccctggactccaacccttgtttctactctgagttcagacagactaaacagactgttaaacatcctgtgttgttccaattttgcatttgacactgcttcaccttgcatcaaatttatgcctgcctttcactttacacaaaatttttatctggtcccctgtgggacttttacttacatctctaacacctttttgcttggagtgatgcccttccgaactctccagtccctttaaaaccttcttatccactttgtaatctctctctttctctcactcatattcataaataatactgtgtgcagtgtagtgtataatctaagggttctgaataaaattgtctataatttccaatggatacactactatatgaaattcagattacttatacaaatatgaccaccctccgttttattgatgcagaatattcattacaatatcaatttcttatgactctaaaatgattaaatttaaaatgaaattatttttcctgattttagatactgggaaacacaaaaaggataatgccttctgcacactcatggaagattggaggatattgatctctagccacatagtgaaatccagttatcacactggcccatagttttcaatgaaggcgctaggaaatatgaaactcccaaataccaacacattttctgcaactcagctcactaggagatttagcaggaataaagttctaccctatttacacttattaaagtttttatttcttttttttcttttcctttgtttattaggtattcatttcatttacatttccaatgctatcccaaaagtcccccacaccctcccccacccactcccccacccacccactcccacttcttggccctggcgttcacctgtactgaggcatataaattttgcacaagaaatgggactctatttccactgatgaactactaggccatcttctgaaacatatgcagctagagacaggagctctggggggtgggggtgtactggttagtgcatattgttgttccatctattgggttgcagataaccccagctccttggtgctttctctagctcctccactgggggccctgtgatccatccaatagctgactgtgaacatccatttctgtgtttgttaggcctcagcatagtctcacaagagacagctatatcagggtcctttcagcaaaatcttgctagtgtatgcaatggtgtcgtcctttggaggctaattatgggatggatctctggatatggcagtctctagatggtccatccttttgtctcagctccaaactttgtctctgtaactccttccatgggtgattgtttccaattctaagaaggggcaaagtgtccacactttggtctttgttcttcttcagtttcatgtgttttgcagatagtatcttgtatcttgggtattttaagcttctgggctactatccacttattagtgagtacatatcatgtgagttcttttgtgattggttacctcaattaggataatgtcctccaggtccaaccatttgcctaggaatttcataaattcattcttttttatagctgagtagtactccattgtgtacatgtaccacattttttgtatccattcctctgttgaggggcatctgggttctttccagcttctggctattataaataaggctactatgaacatagtagagcatgtgtccttcttaccggttggggcatcttctggatatatgcccaggagaggaattgtgggatcctccggtagtactctgtcaaattttctgaggaactgccagactattttcagagtggttgtacaagcttgcaatcccaacaacaatggaggagtgttcctctttctccacatcctcgccagcatctgctgtcacctgaatttttgatcttagccattctgactggtgtgaggtggaatctcagggttgttttgatttacatttccctgatgattaaggatgctgaacattttttcaagtgcttctcagccattcagtattcctcaggttagaattctttgtttagttctgagccccatttttaatggggttatttgattttctggagaccaccttcttgagttctttatatatattggatattagttccctatctgatttaggataggtaaagatcctttcccaatctgttggtggcctttttgtcttattgacggtgttttttgccttacagaagttttgcaatttcatgaggtcccatttgtcgattctcaatcttatagcacaagtcattgctgttctatttaggaatttttcccccgtgtccatatcttcaagaattttccccactttctcctctataagtttcagtgtctctggttttatgtggagttttaagaaataaaaatagcctgtgatattttcataaaacctgggtatttataaaatagtgggtttttaaaaaatattttttattattatgtatttttctcaattacatttagaatgctatcccaaaagtcccccataccctccctcccactttcctacccacccattcccattttttggccctggctttccctgtactggggcatataaagtttgtgtgtccaatgggcctctctttccagtgatggccgactaggccatcttttgatacatatgcaactagagtcaagagctccggggtactgattagttcataatgttgttgcacctacagggttgcagatatctttagctccttggatacgttctctagctcctccattgggggtcctgtgctccatcaaatagctgactgtgaccatccacatatgtgtttgctaggccccagcctagtctcacaagagacagctatatcagggtcctttcagccaacgcttgctagtgtatgcaatggtgtcatcatttggaggctaattatgggatggatccctggatatggcagtctctagatggtccatccttttgtctcagctccaaactttgtctctccagaaaatcaaataaccccattaaaaaatggggctcagagctaaacaaagaattcttacctgaggaatactgaatggctgagaagcacctgaaaaaatgctcagcatccttaatcatcagagaaatgcaaatcaaaacaaccctgagattccatctcacaccagtcagaatggctaagatcaaaaattctggtgacagcagatgctggcgaggatgtggagaaagaggaacactcctccattgttgttgggattgcaagcttgtacaaccactctggaaatcagtctggcagttcctcagaaaattggacatagtactaccggaggatcccgcaattcctctcctgggcatatatccagaagatgccccaaccagtaagaaggacacatgctccactatgtttatagcagccttatttataatagccagaagctggaaagaactcagatgcccctcaacaaaggaatggatacagaaaatgtggtacatttacacaatggagtactactcagctataaaaaagaatgaatttatgaaattcctaggcaaatggttggacctggagggcatcatcctgagtgaagtaacacaatcacgaaagaactcaaatgatatgtactgactcataagtggatattagcccagaaacttagtatacccgagataagatacaatttgcaaaacacatgaaactgaagaagaacaaagaccaaagtgtggacactttgccccttcttagaaataatgggtttttaatggaaaaaaagcaaatacagcagacaaggggatatacttaaggaaaacaattttggcatactcatttgcaattccaagagtatctgacctaagtcttcagagttgttcagatcacaacctaagaaattaaaaatcatttaaagtgaaattttattttgttgatatcctctttatttaccattctattcagcttagtttcatgaactctaaagcatggttagaagttcttggtaagaatctgtagtcaaacctgtgcaaatatagtgattttccatccatacacaacagttgcatgtgtaattgaagcactgtggtgactcactagcacagccttgttgcagggagcatggtgactcaagtcaattgtagcaggtcctgctcagaagagagacagccaaaggagtgagtttcatccatttgaagaatggtggacaaagaaatgcagaaatcaagcacagttaccaaagccaccactgtgtcttccatagctggacactcattttacatgttaaggattgcagatgttaggaattggaaccttgttgtataaatgtaaaatctttggatctaaagaatcaaatcagaaagatatcagataaggacctggactcagttgcccctccctccatcacatcggcttcacggtgcttctacttttggtctatcaatgtgtcctgtcactttagcatagttctctttctggtttgacttgtagtttttatgacaattgctttgtattacaagtggaggtcagaaatggtgattctgccggaaggtattttattattttactattttgactatcatggattaattattttttcatataaagttgagaatatttgcaagagaaatttatatatattttaatgtaccagttcattttacagacacacccatcccagcacgtatttcttatatactaatatgtataaaataaatgtgtaaaatcccagttacatttcctggctttattattatagttaaatttattaactttgccatattactatgatattatatgtccctcctgttcaaaatctcctgtcttatgtcaatggttcaaatttattttttatgtactcttctctcatattcagagcatcaggtcttatgttatagtccttgatctacttgcagttgagttttggcatgtaatcaataaagatctaatttcattcttttatctgtaactatccagatagatcagaaccatttagaggaaaacatttaaattttgtccaacaaacatgtgactgtatcagtactggattatatgtgtcatcatttcttttcaattgatcaatgtaacaaattttaattcatattgtgtagattttgttaattttactgtgtaggaccatgttaaatctgggatcttggtaattccttctgttcttttatgcagggtttttatttttgtttttgttttgctttggtgattttttttgttttgttttgttgaagtttttgtttgtttgtttgttgttttttgtttttgtttttgccaaagtgaaatttcttgttcccatatgaaattacaattatacttttaattttgtatgaagaattttgcaggaggttatagttaatgtatgaattgtttttggaagaatagccatttgcacagtaataggtctgtcatttcatagagagagagggatttttaccctgtaatttcttcaattaacttttctagtttcttaaattgtcagtatagccttttataatttgtttgtgtgaatgtgtgtgtgtttgtatttgtgtgtctctgtgtgtgtgtatatgtgtgagggtgttgtgaatggcattgtttctatggttttttattagtatctttgttctatatgaaacctattgaattgtttattaaattattatcctgtcaccttttctaagtgtatcactaaaaataggcttctggttgaaaattaaggacatttgatatatagaaacacataaatacaaacgaatacagtttaacctctgacgttactatctatagcatattttttctcctttgttctttttcttgcactaagacctctaataatgtaataagtaggagttgaagagtgaacatccttctcttgttccaaagtactatcataaatatcatttacaactattctggctcttaccttgttatatgttgtctctcttaagacaaaatatgttctctgtatccttaccagtggccacatttctaaagaaaagtgacacttgctcactaggagccatcaatgctgatgttcccaggtatatgcccaaacaatacatgagtactcatttactgtactgtattttgcatggctttttaatttatgttttcatcaacactgaatgcaacaagaatcatgactaaccaaaccctgagaacagcacaaatttctggatataatcagaaatatcttttttgtgtgaaaatgacaaattataatagcgtcaaataattttatgctagaacctacatcttcccacatcatgtatttaactatgtttgcagtgccatacctgatttttcaccctgtgaagaaagtctcaattgcaataaagaaagtggttggatagtcctataaacagtcttaccactactacaccactggttcattttggtttccatgtcattatagtagcctacaatatacagcaatagataaaaatcattatcttatcagactgaactcagggaacgtggtgggggatctggcagaggactggaggaccaggggggagttgcatctccatggaaagaacgacataagctagtctgtttctcttagagattagaccaaccaaggagtgtacctatagcaaaccatggctccagatatatatgtagcagaggatggcctaaactgacagcaatgggagaggagactcttggtcccggagaggtttgatgacacagagtagggggattctggatttggtgagacagtgtgggtgggtggggaagcactctcatataggcaaaatggagggggagagcatatgagggatggagggtggtagaggggtaaccaggaagtggaatatcatgggatgggtgatttgtggagggagttaccaggaagtgggatatcatttgatatcattttagttgtaaacaaatagaattatatatatatatatatatatatatatatatatatatatatatatatacacacacacacacatatatatatatatattcctttctcttgctaacaaactgaatagagctttctagtactatgaaagatagctaacagaaacaattttctggctagctcaagcttgatttttatgtctggcaaatgaaatatgtaataccttcaacaatgtggtcttgtcacatttttaaggagaataaaaaataatcatgtgttattttagatgctttattggtttctctgaccaataactattacagaattaatctctgtctttcaataacatttgtatttaataacccatgtattcttgatcttcattctcttattaattacataaggtttaaggctttgtgtccagaaaatatcctcaacaatttagtaatcttgatttcttacaggtctaacacttttaatacagatttgtcactggtaatattgaatatgtgagtaaaagaaatatctccttttgttagaaaattcttttaaagcatgaatttttcaaacaaaaagaagtagatggaatttacaatgttaaatcttatgtgtaatcccttcttgggtgagatgaactgtgagtaccattgtttgagtactctttggataacactagttgtgagaaatcctagactgtagttttcgactcagtttccaaaagcaccaaaagaactgatattaaatatggggagaattagataaagaatcaaaatgttatttatctgactcaccagtaaggaaaaaactattgcaagcaattcctattacaggcttgaacaattggacagtacaaatgaaatcagatgcttattagtgtttttgaaacagttgagatatgcaggtgtagatcatagtagaaattatgcccactgggatacatttcctgagttgaaaccccagtgtttcaataaaaaataaatttcaggcacctgtgagtgggtagagaggtagaagtgaactccagtcaaccaaatgacagttccatacaggaaagcatcatggcaaaagtagagaactgacttccacatattttactctgaccaataaatgtacatcctcccaagagtagattaatttaattttaaagtcttaagaagaatgaacatgccaggcagtggtggcacatgcctttaatcccaggacttggggggggggagggcggcagaggcaggcagatttctgagtttgaggccagcctggtctatatagtgatttccaggacagccagggatatacagagaaaccctgtctcaaaaatcgaagaagaagaagaaggaggaggaggaggaggaggaggaggaggaggaggaggaggaggaggaggaggaggaggggaggaggaagaggaggaggagaagaaggaggaggagaagaaggaggagaaggaggagaagaagaaaagaatgaacatggaatatatatttgtttttaattgctaattttttaaaatagaatttttcaggcaatatattataattgtgtgccacgtcattttctcctacctgatttttgctacctccataaccacctaaaccttcttgttctctctctcacacacattagaaaacatagaggcaattaaaaaaaaaactaacagaaataaaatggaactaacacccaacggaatcagaaagaaaactcacaagaagcatatacatacataaagacatatgcccaaacataaagacaaattaaaacaaaaaattcaaagtcataatatatgaaaaaaatcaccagtctggttaaaatacagtacaaaatgagtcaaaaatcataacccaaaattattgttgattcacatgtgttatctatctactgcctggaattggattctgcttcttcatgtggattctatacccagtaaggtactactggggtgtactagtttttccattttgagaatgtgtcaaatagagatacttcctggtgaagcgtggaagatcatatattatttttgctctcagtgcatgggcccttaaataactttgacctgtacaaaccttgtgcatgtgtcattctttgtagtacttcacatgtgcatcagtcctattatttctggaaggtattgttgccttcctggcatccctcccaccactggcctttgtagcattctacaatgtcttctgaaaattttgctgagccatgaagaaggaattcagatggaaatatgtgatttatgataggatgattcaatgtttttactctacacattgtacagatatggttctctgtatctggccccatttactgtatatgttagcttcttcaatgaaggtgcaacaatacattgaactatgagtataacagaatgtaatttaaaatacttttatagatacacatcataccttactgtggaaggtcaaatagtatagaactgggttggtgtttaaatttctactcaggtgccatgcagaataatttttagtaccacaaacactattcagtaggtgaaggttttagctaggcacctacttgtcttctctatgtgtaatagaaatgtaagcattatcatctgcaataaagacatcattggtttgtatagaaccatcaacaacttggacaaaaatctaagttggggaagggaaactgggtttctcaagatgaatatttctctgctttatttaactctgagttctactattttcttaagagctgcgtaatattccattgcataatgtaccacatattcagttaccatttccccacttatgaaaatctaggttgtctcctctttctttctaatatgaatatacttggaatgaataggtgtctatatagtaggctatagactcattttttggatatatgcccaaaaatgatacacctgcatcttgaagaatgacatacttaggtatacaaggcaaatcacactgatttccaaagggctgaactactgtttttttggaccagtagtggataaggattcttattattcatcatcctctctagcatgtgcagtcatttgttttattgatctggggcatactgattagttgaagattaaatctcagtgttgtttgaagatgcctattcctgattactaaaaatgttaaacttttcttttagtgaaacaaatattttcatggtcaattatgggtcattagattaaaaccacatgacaagtggtgcttgaagcagtgttgcctctatgctcacagtgacatgtagcttttgaccaaacaggaaagttgatggaaacctctaaaaaagagttcttaggattttctaaggatataaacattcatatcaaagcataatcctatccataatttctacaggggacatctaaggtatgttctccttcaaaaacataggaagcataatgcaggaccctgtgagctggcgcattgcattatacacaaattagcacagtagctaaagataaatgagaatccagtaataattctctgactgacttaaaaaaatgaatgggatttttgagcagggggaggatgatggaatagggagttttcagatgggaaaccaggaaagtgcataacatctgaaatgtaagtaaagaaaatatccaataaaaaaagggtggaaagaaatatttgcatgggcacatacaatgtgcagatttaaatgacaaatttaaatctattagatttaaatttattagacaattgggtctattttatttttttatacttcattttgtttaggtgcacattctaccacatattttcatttcagttacactataaatcatgtaacaaagaggactttatctgttaaagtgttgtaacaacaacaaagatgctactgcagtgtcctgctccagttcatagactggctacaggaagtaaatcataaaagtgctgcgtggaatgatgccctgccccacaggcccctgacctctggcaagacaaaatatggtgaaactacaaagaccaaagttttcttgcgttttcaacttcttttggtgccaagcttagaagtgacacctgccttcattaaagttttgtggtagcaggaatggtttgttttcaccaggttcctgttcaggacttgttgattaaatcatgaatttgcaattattgctgatagtacaatcctgcattttttccttaatcatgttttcttcagatatagatttacacatgcgccaaaaaattgctgttgtaaaataagatattgacaagttcaatattaattcggggactacagaagtcaagagtgaccgcacagtttatttggtttgttgttgttgttgttgttgtttgtttttgttttgttttgttttttgtttgtttgttttttgagacagggtttctctgtgtagtcctagctgtcctgatactcactctgtagaccaggctggccttgaattcagaaattcgcctgtacagttttaaaatgaaaaaaaattcataggattttgagcagattcataggctgttgtggatttttttaaacataatttatatgtgattctttaaatggaatgtggatgtctaacactggacatgctttgtattatgcagttctttaatatatctgccaatatatatatattgcacagaagtgcaagacaaagttttataggaaatacatgcttcagtgccacataatttgccatcaagtattatgccaattacaggatatggggagtggtggtctcagttactttaattaattttgtgggttttttcatttaatactcatttctctttttagactgtcagcaaagctctttgttatgatatcaaaagaaacttcaacatacaatcttcttgtgaagacatatcagaatgcatcataagatcttggcaattcatttatagtcaaaaagcaagtgaaggaccagtggatagaaaatgactaagtactggggaagactgtctcaataaggataagacattatatgctggtaacaatatggagaaagaggaatactcctacattgttgatgggattggaagctggtataacctctctggaaatcagtctggcacttcctcaggaaattggacaaagcactaccctcaggtatccagctatttaactactgggcaaaaaaaaaaaaataccccaaaaatgttccaacatataacaaggacacatgctccactatgtccatagcagccttatttacaatagccagaagctggaaattaccagatgtccttcagcagaggaatggatacagaaaatatggtataaaatattcatgggcggtagagggtgggagggacttgggaggaggaaagaagagagaaaaaggaggcaggatcaggcatgagaggagttgggggtgatatccagaggctcaggaatttaaacagaggtgtgtagaaatgagagatgggggactgagggtagccaccagcaagtcccagatgaaaggaaagcaagaggcttccaggacccaacggggatgaaagtagctgaaagctaatatctgataaatctaccacttggattacagatttgtcaatagtaatattaaatacatgagttacaaaacattttcgttttattggaaaagtgtttatttcaccttaaaattttcaaatcacacaccatccctgagtgaagaaaaggtggagacagggactttagcagaagccatactgatgatttccaatttgcttcctgtggcttgctcagaatgattccttatacatagcaggattactgaccacatgtggtaccacacaaagtgggctgggtcctcacacatcaatcatcaattaagaaaatgactcacagacttgtgtacaggcaaacagaaagacacagttcaactgaaattctctattttcagataactcagcttgacataggtaacaaaaaataaccagaaaaaatgtgcacataaatgtacataacacatattttatatattacagaatttatctacataagtgagatacatttttgatcagtgaaccagaattcaaagtccagaaacaaggcaaaattgaatgagcagttgatttttcacacaaaacccccgaaaacctaatggttctcaagtggctttttctttatatgtactaacactcatttatttggaaatcttttaagataaataaacttacttttaatgcactttaaaatcactgaaaggaagataataaaatatataaattacttcaactgaaggacatttgtttataacttttccattgatttcatatatatatatattacagttattaactctatgtgtgtatgtatgacttgtatgtaagtgtaggtatatacatgaaacagtatacctgtaatgatcagaagataatctttgtgagctagttcagtttcctccatgtagattccaggtatctaatttatgtctctaagcttgcatggcaggatgccaagatatttcattggcccgtttccattaacaatattgaattaaataattaaatgcacataaggcaagtaccacatcatcctagtagtatatgtgcatttttatggttgcttttgaggacaatttccaataagaagtattgggggttaatttctcaaaactttgtgaggcatgttcaatttatttacttcaaattatcaataaattctaatttattttttgaaaataattttactggtcattttattaaatatgttttactttcaatgaccctgctgctacacacagacacaaatactacaaatgtaccagtaaatattctacctgtttttattttaataacattaagaaaaacttcttacaatgttgtaacagggtatagtattgtgacttgtaacatagcaagtattttgaaatagcctgcagtacttacatggaagaaaagcatgagttatgttgccaaattcctgatagtggaaagaagttgccctctcaatgggggcttattctgtcacaagggactgagtctgtttggaaaagtctgtttcctcatatactgtgtggaagttactgaaaaacatttgtatttaagacatttcttttcatttccatcagaaattatctagctttcattactaattggagtttaaaaatggtgtgttttgacttactggagtgcttgttattggaaaacctagtggccctcatttatccatctctgggttctatgggatggcatgattatatgttctccttcaattcacttcttttttccattaatttatttattcattttgcatcccaatcactgatacctctccttgtattctgttcacagggtacttttctgttaatcttctttctcttatattctgagagggtggaggacacactgggtattgcctgaccatgatgcctcaagtctattaaaaagtatgtgcatcctctcccactgagggagaaaaagaatctcagcacaaggaattgactccacaaagaggcaaaagagttagggtcagcccctgctccagtttttctaggacccacatgaataatgagctccacatctgctacatatgtatagaggtcctaagtttaacccctgtttggttggtggtttggactctaagagacctaagtatccaggttagctgattctgtgcatttttctatagatttactatccacttcttggccatcaacccttccataagattcccacagctccaatcaatatttggctgtgggtctctgaatctgcttctgtctcatgctgaatgtctcctctcagagggagtcatcctgggattctgtctgcaagcacagcagaatacctttgagagtttcaggcattggtgcctgaccatggggtatgtctcaagttggttgggttattgtttggccattccctggatatctgctccttctttgtcactgcatttcttgtagataggacatatttttggtcaaaagttttgtgtatggtttggtctccttgtccctccacttacattcatgcctggaaacttgaattatccctttcaggctttgtatcccacaagagaggaatttaaattgtaacacatccttatcttatctcttctgtaatttaactatctactgacctgggcttgcttctgtcctgggggtgcccaggcttccttgttcaccattctggaatggaaagaatgaagcttagctggaccaggttgtttaaagaggaatgtggtctgcatgagtgttagataaatggccttcttcagagatggctttcacctaaactgcttttatttattgggtaaaaagagttatataaactgcagagaagataggagattggggatgagtatgcattattagctgtggctgaagtgctaggaaggtttcctttgcctaaagaagaattctagatgcttactagagctatcctcatagtgagagaggaagtttaaacagtaatttagctaccagactactttactacttcaatagtaatggaggttgtgtcataaaacctatgttctttgggacaaactggcccagaacaacttggaaaatagccctacttctgctgattttcagtgacctcattctttctccagactgtctccacagggcattccattctgggcctgaaaactatcctctaacatttacatactgaaactgacgaagaaaaaataatgggtcaaataaagttgttggttacagttggctgaagagatggatcagcagttaagagcaccaactgctcttccaaaagtccagagttcaaatttcagcaatcacatggtggctcaaagccatctgtaatgggatttgatgacctcctctcatgtgtctgaagaaagttacagtacacccatataaataaaataaatacaacttaaaaataaaagtgctatttacaagtaacaaaaagtattgttacttaagaccaaattttttattaatttggaaaagagataaactacccaaaagagaaatactaaatctaggacaagaataaattctaaaatgtctaaattataaagaactgtatatacaacggaactaacatagtcaatgttgataagatatgtgatgggtgggatatacagagggtcagaaaattgaatatatgtttgtagcaatgggggatggagaactcaggtagccaacagaaactccccgatgccaggaaaacagaggttcccaggacccaacagggatggcattaacttaaataccaaactaaaaggagggagagcctgtggagaccatatccagaggttaggcaatgccccaagttgcaggatatgaccacccactcatctccaaacatttaatccagaatttctcctgtctcaaggaaatacagggacaaagtgtggagtagagactgaaggaacagccatccagaaactgccccacctggggatccatcccatatgcagacacaaaatccagacactgttgctgatgccaagaagggtttgctggcaggaccctgaaaaagaccctggttgctgtctcgtgattgactctgccagaaactgacaaatatagttgcaaatgctcacagccaaccaacctactgagcatagggatcctaatggaggagtttggggaagtactgaagcagctgaaggggtttgcaaccccaaaggaagaacaacaataccaaccaatcagacatcccagagctcccaggaactaaatcagcaaccaaagagggcacatggagagacccatggctccagctgcatatgtagcagaggatggacttatctggcattaatgagaggggaggcccttgatcctgtggaggctcaatgccccagtgtagggtaatgctagggtagtaaattgggagtatgagcataggtgaaagaggccctcatagaagcaggggaagggggtaagggataggagttttccagaggagaaactggtaaatgggataacattttaaatgtaaataaataaagtatccaatctaaaacgaaaaatagtaaatttaaaagtaggataagggctggtgagatggctcagtgggtaagagcacccgactgctcttccgaaggtccagagttcaaatcccagcaaccacatggtggctcacaaccacctgtaacgagatctgacgccctcttctggtgtgtgtgaagacagtacttacatgtaataaataaatcttaaaaaaaaaaaaagtaggataaatgattttgaatgccctgcacttccaatatctcaaaaaatataaagaaccatatatgcaatgcaaataacatagtcattgttaataagatatgcgatggtgcaagcagaggaatctgtgggtagataggttgtttgcttctctaaattgctattgttacttctgttatttatactatggtctttaatgttttaccttcatgtacagcaatcctattttatcattgcatataaatataatgtcatatacagcagaagagtctaataatcacacctggatcaggaaaataattaatactggtatgatcctggattttcctacttaatgcttttaccaactctttgtataccctgaattttgccacatattttcagcatttaagaaagatttcctagaatcatgtgaaatataacattagattgttgaatgtacagaatgtgatttttagacaacaagggagacactcaactaaagcttacagaaaaaagaaaaatgatatcacctaaatgtttgagaaatttgaatgattcataagaatattgcaattttgaatatttggaatgttaaagatctaaaatcaaaatatcttgggtgtttttgtacctatattagcaacttatcacccaacctcccctcatttaacatactttcaattagctggcaaaacttttgaaatttattattagatcactagctaaagaacagaaacatgaaacctacaatagatttatcatcaagtgtcatattaaacttaaagtaggtattttctcattttccataccccttcaggagattttcctcataaaatacctataaaatacattaatatatgaattttttttacaatgtggctatgcaaatctttgtaaatactttaatgttgcaacatatgttgaagtcatcctaaatctctgttctacgtgctgacatccatacttgactaagagaaagtaacctattattttccttttcaagtaaaatttggggatccatcaaaaatgtgtgtccacatatgtataaagttgaatatcttcatattctattaagcctaaactcttattatgatactgaaaaaatttatcactttaccctttccaattttcctgtatttacctttccagtataatagggagaatatttctatactttattttataattgaatatcaaaacagatttaaatttcatttaaaatattaagtcaatttcaatatggcaaataccatcagtaactaagataaaaattataatgtgcaaacaatgtattcgtttgaattagatttccatgttttctttaaaatttccttcttttcctctcacttttctttaagtaaagtgtcatcataattttttataaattttattttcttctatattatttaacattacatcacaaatctaccagggaaatttttttgttcgtttgttttgatcctgtgttaggaatgattacttgtggttttggatctgtttgtttgcttgttttattagttattatgtagtcaaaactgctgaacacctgaattctgtctgacttagtggaacatatgttagcatcactggaatggagaaaatccccacacatttatactcatagtggaaacgtaaaacatgatcattaaaaggatttggggaaatgttcttaatgttagagatttttattaaaaatttattttccacagtaatacaccctgattagagttgttctcccttgactagtcccagtctctgcccacatgcatttctattattacaaaacttttctaagaactacaaaataaaataaaatggtaataagaaatagtactaacataaagcaaatgctaacacaatggaaatagacaaaaggaacaagcagaaggaaaagagtccaagggaaaagcacaagaaaaagagacacagaaactcacgtatttcaggattctatactaatgttaaaatggaagacataatataggcagtggaccaagtgcaaacactcttgagagttcttatgagctcagtttatattgtttaacaaagccttgttttcttggtgctccccatgtgttctggatatgactcttgatttgcttcctctttttcatggttaacttaacagtgaaaggatggatttggtggagtcaataaggtttaggatgagtgtcccaagaatgctcactctctgaataagatgcaatgtgggtcgttgtacttattcccaactcatgaagcagtcatgaagttaaattgcatattagttggttaatttttccattgcagtagcatatctttcatgcaggatgctattgtaaattaaaggatttgtggcctgcttattgtgtatattcctatttcagtagtgtgtagactacttcattaaccaaacatagtagaacaaggttggaatgtgaggtatgggctctaagttggtatcagctgaacatctcagttttccatgaattttgtatgtgcaagccactcttcttactggaaagggcatttggtaacagacacgtccagttgtacctctgactttcatgttatgaagtaattccagttaatttgcattcatgtatgtatatattcatgaaggcttcagcgtttgtttacaaaataatcctcaaagggcccttaattctaaatgtctatccccatattccctcctctactcacttttctacttcactccttgttattctccctcaagtccccattctgccaatccctatcaaaatatttattttcccactcctaaggagacctatctgtcactcctagtgccttactctaaacttgggttgcagtttgtttaacactgatgaaacaactattgttcacatataagcaaatacatataatttttaacttttgacatctaggtttcatcattcagtgtgatgattcctagttcagttcatttacctgtgaatctcattatttattttttttaaagaatggattttttaaacaagaaaatgtacatggaacttatcaggttaaaacctacctgtaatcccatcctgggcaagataaacttcaagtaactattgtgtgaaaccacttggattgcaatagtcatgaggaaccctaggctacagttttggactctatcaaaaaaacaacaaaagaactgatagcaaatcaggagagaattttacaaaaaaaaattatctgagacatcagttaggcaaaagctgttgcaatcacttcatattacaggcctgaacaaaagaacagttcaaatgaaatcagataattgttagtattgtcaaatccattgagaaatcaacataaaatggatgcctagtgtgttacagttcctgagttgaaaccccagaatttcaatgaaaaaataaatttgaggcaacagtgagtgggtagagaaggtgaaatgaactctagtcaaatcaaatacccaaagtttcataccggaaaacatcattgcaaaagtagagaactgacttccacatgttttcctctcaccaaaaacgtacatccttccaaaaatagattcatttaattttaatgtcttaagatgaataaatgtggaatctatatttgttttaattactattttttaaaaatagaacgtttcagacaatatgttctaattgtgtgccactccactttctcctacctgattcttgtcgcctccataaccacataaatcttatgttctctttcttacattagaaaaaatataggcaaataaaaaataatcaaagcaaaataaaactaacagaagtttcaatatcagagcaaccaaagtggctcactgggtaatgaatgctggctatcttgctctaaacagtcagttgttataaagaagatgccaatataatagaggtgaatgaagtatctgggaagtgattcctcaggcacagcatgcagaaacaaactgtttcaaaaaggacaaagtcataagtctgttacctactgaactcactagtgactagaatcaaccaagtggcactgattatgaagggatcaatacatctggcttgtcactgtgtggcagggatggatttcctaaagacataccagaaggggctacaggtgaaagtacaggccagctgttgcaaggtaccacagttttttgaggatgcaagtatcataggataaccagcaagattagcagaaaccatggggtggagacagcaataaactagaagacgagctatacatgcactccagagggcaaagctagaaaagttactcaaaggttataaaagatattagaaagcagtaagtggatcacagatattaagatattgagttattaacacccttgacgtttgattttgatgtgttcacattcttgcttggttattcactcttaaagtaagaaagtacttgtactggctagttttgtttcaacttgacacagctggagtcaccacagagaaagtagcttcagttgagaaaatgtctccatgagatccaactgtaaggcatcttctcaattagtgatcaagggggaaaggccccttgtgggtggtgccatctctgagctggtagtcttggttctataagagagcaggctgagcaagccaggagaggcaagctagtaaagaacatctctccatggcctctgcatcagctcctgcttcctgacctgcttgagttccagtcctgacttcctttggtgatgaacagcagtatggaagtgtaagccaaacaaaccctttcctccccaatttgcttcttggtcatgatgtttgtgcaggaatagaaaccctaagacagtactcttaaattatttttattttataagagaacatatttcaaagggatattttcaagttttatagagaatttggatttttaaaaacattgcatgttttttaaagactgaattttgaaagtgattgataaagcaacactgagaggctttgtaagtctcaggacagatacgtttgatacttaccctttggaaatgtacttgtctaatataaagaaagttgaatttgatctttattccaattgcaagttagactgtacacacatgggactagagcatcaaggaggtagagacagaaagttatgtagctcaaggtcatcctaagcatttctcacgacagcctgagtccatttcagagaaaagataatatcccctctgtgccattttatggtggaaatatgtaactttgttttacaatggtaacattgaaagtattgacttgagactcagaagatacttttaactattaaacaatattcattctatgaaagatgatggggtctcttaaagttgtataataaatattcttattatttttattagttattttctttatttaagtttccaatggtatcccaaaagtccccccataccctccccctcactcccctcccacttcccacttcttggccctggcgttcccctgtactgaggcatataaagtttgcaagaccaatgggtctctttttccaatgatgactgactaggccatcttctgatacatatgcagctagaaacaggagctctgggggcaggggttactggttagtttatattgttgttccacctatagggttgcagacccctttagctcctttggttctttatctagctcctccattgggggccctgtgatccatccaatagctgactgtgagcatctacttctgtgtttgctagacctcggcataatctcacaagagacagctatatctgggtcctttcagcaaaatcttgctagtgtttgcagtggtgtcagcatttggaggctgattatgggatggatccccgggtatggcagtctctagatggtccatcctttcatctcagctccaaactttgtctctataactccttctatgggtgttctattcccagttctaagaaggggcaaagtgtctacattttggtcttcgttcttcatgagtttcatgtgttttgcagattatatcttgtatcttgggtattctaagtttctgggctactatccacttatcagtgagtacatatcatgtgagttattttgtaattaggttatctcactcaggatgatgccctccaggtccatctgtttgcctaagaatttcatgaattcatttcttttaatagctgagtagtactccattgtgtaaatgtaccacattttctgtatccattcctctgttgagggacatctgggttctctccagcttctggctattataagtaaggcatttttattattatatgattgtaaaactgtgagagacaaagtgtagaacaccgtggtatgaatgagatgcccactattggtctcccatttacaaatacttgattcctacttgatgtcagtttgaggaagattaggaaatgcagcattgctggacaaagtatctccctgaggatagttttctatctttcaaaactcttttgatatgtcaaacaactctctcagctttctctgtgttctgagacataagttgctacttcagcaaacttctgcttgccactcaagacacagaaagactgaaaataaccattttaatgttattaatatatatttgttgttaataaaggattcccaaatatactcctgtctatagttaaattcaatgcagactctctgcctatgtccctaaggtattagattcaaaggcatgtgccaacatgagtgcacatttttaaaaaaaaatatttaattgtaaaagtaattaatgttcaaattaaatgcacattttaaaatgaaatagaaagcattcatggtatattgactcacatatttaatcatatcattcaagagatggaagcaaaagaattactacaagtttgagtcttgtctagactatgtaatgagacactatttctcaattttaaaaaactgaaaaaaggtaagaacaaaaaatgtcaagtaaagtagaagaagaaggaggaagaggagaagttgtaggaggaggaaaatgatgaggaggaggaggagaaaaatgatgatgatgatgatgaggagaagcagcaggaggaggagaagaagaagagggatcccatgatcaaagtgaaaaaaaaatctcaagaaagtttaaaaaaatgattagcacaggtaaactggaattctatgctatggaaaggagggggtttgggaacactggacacacacaaattagtcttctgggaagaaaaatgacaaaagcattgagtacacaattctttatattcccctatagtgtaccctgtatccttttggttaattttaagatctattactttcattctaatacaactcttctaactgcctatgttaagtatccattgaatggggctcaataagtcctcttcattatacagttatggtaagcagtacacagaacttttaataagtttccgagataacactgtcaatgttagaattagaatcaaatcacaaattatgaaggcacaattttaatatgtagaatatcatagtatagattacttcacacatctcaaacaggtttttattcttagatactattgagattattctttctttcagcttgctgtgatttagaatcacattagaggcaagcctctgtcttccttgagtaggattaacttaattaatttaactgaggtaggagatcctgtccttttgtataggacaaggttgaaggagtttgtcattggtctcttcactaacaaattggctttctgggtccaggcaagaaatctacaaacctaagtccatagattgataattaggcatatgtatccacaattactcattacttttatgactaaaaaacataatttattttacaacacaggaatttctttgggtattctcagtgctctcagcccacattgacaaacagtatatggagagattattaaaaatactggattaatgttcctgtgtaggtgaccctacataatccttgattttcgtatctattgtataaagtctggaagacaggatggccatgatataaaaccctttaaccttgacatgctaggtggcagataaagatgaaatactgtatgtttaaggccagtcttttctatacggtgccgttctggacagagtgctattcatgcaaatgggttctttaaaaataatgtcagtttgtcttactgaatattttctgcctggcatcctctgacaattttcacaaatacaacactatagcattgtagtttcagtgtattttttcccctatagtgctgtaagatcaagaatcgataaatgggacctcataaaattgcaaagcttctgcaaagcaaaagacaccgtcaataagacaaaaaggccaccaacagattgggaaaggatctttacctatcccaaattggataggggactaatatccaatatatataaagaacacaagaaggtggactccagaaaatcaaataaccccattaaaaaatggggctcagagctgaacaaagaattctcagctaaggaataccaaatggcagagaagaacctgaaaaaatgttcaacatccttaatcatcagggaaatgcaaatcaaaacaacactgaggttccacttcagtccagtcacaatggctaagaacaaaaactcaggtgacagcagatgctggcgaggatgtggagaaaggggaacactcctccattgttggtgggattgcaagcttgtacaaccactctggaaatcagtttggcgattcctcagaaaattggacatagtactacatgaggatcccacaatacctctcctgggcatatccagaagatgtcccaaccggtaagaagaacacatgctccactatgttcatagcagccttatttataatagccagaagctggaaagaacccagatgcccctcaacagaggaatggatacagaaaatgtggtacatttacacaatggaatactactcagctattaaaaaatgaatttatgaaattcctaggcaaatggatagacctggaggttatcatcctgagtgaagtaacccaatcacaaaggaactcgcacaatatgtactcactgataagtggataatagcccagacttaggatacccaagatataagatacaacttgccaaacgcatgaaattcaagaagaacgaagaccaaagtgtggacactttaccctttcttagaaatgggaacaaaacacccatagaaggagttacagagacaaaatttggagctgtgacgaagggatggaccatctagtgattgccatatgcagggatccatcccgtaatcagcttccaaatgctgacaccattgcatacactagcaagattttgctgaaaggacccagatatagctctctcttgtgagactatgccggggcctagcaaacacagaagtggatgatcacagtcagctattggatgggtcacacggcccctaatggaggagctagagaaattacccaaggagctaaagggaactgcaaccctataggtggaacaacaatatgaactaaccagtacccgggagcttttatctttagctgcatatgtatcaaaagatggcctagtcggtcatcactgcaaagaggggcccattggacttgcaaactttatatgccccagtacaggggaatgccagggccaaaaaggggcagtgggtgggtaggggattggggaggtgggtatgggggacctttgggatagcattgaaaatgtaaacgaggaaaatacctaataaaaaaaaaagatagccaaaaaaaaaaggaatgaatatttgaaaggtatctttaaaactcaaatggcaggagtattttttcaggaaggtttaaacttctccagtactggcagaagctacaaaggaactgaagaagcacagcctatataaggtggtcatccccttcattcagtatggcagaaagttggatattactatacttatatgttcattccgacattgcagcaaacttagccacacagagatacgtttttgaaagttctgccatgaggtaggaaaccagatatttccatatgcattcagagccacctatttatttttgcagatttttttccttccatgatttcatagggtacaatgcagaattttaaagtacattttaattaggtattttcttcttttacatttccaatgctatcccaaaagtaccccatactatcccccaccctctcccctacccacccactcccactttttggccctggcattcccctatactgaagcatataaagtttgcaagacaaataggcctctctttgcaatgatggccaaataggccatcttctgatacatatgcagctagagaaacgagctccgaggggtactcgttagttcatattgttattccagctataggattgcagacccctttagctctttgggtactttctctagctcctccattgggggccctgtgaaccatccaatagctgactgtgagcgtccaaatctgtgtttgctaggcccctgcatagtctcataagagacagctatatcagggtcctgtaagcaaattcttgttagtgtatgcaatggtgtcagcgtttggaggcagattatgggatggatcgcctatatggcagtctctagatggtccgaagtttcgtctcagctccaaactttgtgtctgtaactccttccttaggtgttttgttcccatttctaagaaggggcaaagtatccacactttggtcttcattcttctttagtttcattagtttcacaaattgtatcttatatcttgggtattctaagtatctgggctaacatccaattatcaatgagtacataccatgtgagttcttttgtgattgggttacctcactcaggatgatgccctccaagtccatccatttgcctaggaatttcataaattaattctttttaatagctgagtagtactccattgtgtaaatgttccacattttctgtatccattcctctgttgaggggcatctcggttttttctagcttctggctattataaataaggctgctatgaacatagtggagaatgtgtccttcttaccagttggaacatcttctggatatatgcccaggagaggtattgtgggatcctcatgtagtactatgcccaattttctgaggaaccaccagactgatttccagagtgggtgtacaagcttgaaatcccaccaacaatggaggagtgtttctctttctctacatcatcgccaccatctgctgtcacctgagtttttgatcttaaccattctgactgatgtgaagtggaatctcagtgttgttttgatttgcatttccctgatgattaatgatgctgaacattttttcaggtgcttctcagccatttggtattcctcaggtgagaattctttgttaagttctgaatgccattttttaatggggttatttgattttttggagtccaccttcttgagttctttatatatatattggatattagtcccctatctgatttaggataggtaaagatcatttcccaatctgttggtggcctttttgtcttatggatggtggcatttgccttacaaaagctttgcaattttatgaggtcccatttgtcaattctcaatcttacagcacaagccattgtgttctattcaggaatttttcccctgtgcccatatcttcgaggctttcccccactttctcctctataagtttcactgtctctttttttttttatgtggagttccttgatccacttagatttgaccttagtatgaggagataggaatggatcaattcgcatcttctacatgttaaccgccagttgtgacagaaccatttgttgaatatgcttttttccactggatggttttagctcccttttcaaaggtcaagtgaccataggtgtgtgggttcatttctgggtcttcaattctattccattagtctacttgtctgtcactataccagtaccatgcattatttttatcacaattgctctgtagtaaagctttaggtcagtcatggtgattccaccagacgttcttttatctctgagaatagtttttgctatcctaggttttttgttgttccaaatgaatttgcagattgccctttctaattcattgaagaattgagttggaattttgatggggattgcattgaatctgtagattgcttttggcaagatacccatttttactatattgatcctgccaatccatgagcatcggagatctttccacctttggagatcttctttaatttctttcttcagagacttgaagttgttatcatacagatctttcacttccttagtttctgtcatgccaaggtaatttatattatttgtgactgttgagaagggtgatgtttccctaatttctttctcagcctgtttatcctttatgtagagaaaggccattgacttgtttgacgtaattttatattcagctactttactgaagctctttatcaggtttaggagttctctggtggaatttttagggtcacttatatataatatcctatcatctgcaaaaagtgatattttgacttcttccattccaatttgtattcccttgatctccttttgttgtcgaattgctctggcaaggacttcaagtacaatgatgaatagggggggggagaaagtggacagccttgtctagtccctaatttttgtaggaatgcttccagcttctcgccatatactttcatgttgggtactggcctgctgtagattgcgtttatcatgtttaggtatgggccttggattcctgatctttccaagacttttaacatgaatgggtattggattttgtcaaatgctttctctgtgtctaacgagatgatcatgtggtttttgtctttgagtttgtttatatagaggattacattgatgtatttctgtatataaaaccatccctgcatccctggaatgaaacctacttggtcaggatggatgattgttttgatgtattggatttggttagtgagaatttttgcattgatattgatcaagtaaattggtctgaagttctctatcattgttgggtctttctgtggtttaagtatcagagtaattgtagcttcacagaatgagttggatagagtaccttctgcttctattttgtggaatagtttgtgaagaactggaattagatcttctttgaaggactggtagaactctgtactaaacccatctggtcctaggctttttttggttgggagactattaatgactgcttctatttctttcagggatataggactgtttagataattaacctgatcctgatttaactgtagtacccagcatcagtctagaaatttgtccatttcatccaggttttccagttttgttgagtatagccttttgtggaaggatctgatggtgttttggaattcttcaggatgtgttgttatttctcccttttcatttctgattttgttaattacgatgctgtccttgtgccctccagtgagtctggctaagggtttatctatcttgttgattttctcaaagaaccagctccttgtttggttgattctatgaatagttcttcttgtttccatttggttgatttcacccctgagtttgattatttctcgctgtctactcctcttgggttaatttccttccttttgttttagagcttttaggtgtgttgtcaagctgtttgtttgtgctctttctagtttctttttggaggcactcagagctatgagttttcctcttagaaatgctttcattgtgtccaataagtttgggtatgttgtggcttcattttcattaagctctaaaaagtctttaatttctttctttatccctttcttgaccaaagtatcattgagaagagtgttgttcagtttccatgtgaatgttggctctccattatttatgttgttattgaagatcatccttagtccatggtgatctgacaggatgcatgggacaatatcaatatttttgtatatgttgaggcctattttgtgaccaattataaggtcagttttggagaaggtaccatgaggtgctgagaagaaggtatatccttttgttttaggataaaatgttctgtagatatctgttaaattcataacttcttttagtttcactgtgtccctgtttagtttctgtttagacaatctgtccattgatgaaagtagagtgctgaagtctcccactattattgtgtgaggtgcaatgagtacttcgagctttactaaagtttctttagtgaatgtggctgcccttgcatttggatcatagatgttcagaattgagagttcctcttggaggattttacctttgatgtgtatgaagtgtccctccttgtcttttttgataacttttggttggaaatcgattttaatcgatattagaatgtctactccagcttgtttcttcagaccatttgcttggaaaattgttttccagcctttcattctgaggtagtgtctatctttttccctgaaatgggtttcctgtaagcagcagaatgttgggtcctgtttgtgtagctagtctgttagtctatgtctttttattggggagttgagtccattgatattaagagatattaaggaaaagtaattgttgtttcctaatttttgttgttgttgttgttgttaaagttggcattctgttcttggggctgtcgtttttttagatttcttgaaggattactttcctgctttttctaggacatggtttctgtccttgtattgttttgtttgtttgtttgtttgtttctgttattatcctttgaagggctagattcatggaaagataatgtgtgaatttggttttgttgtggaatactttggtttctccatctatggtaattaaaagtttggctgggtatagtagcctgggctggcatttgtgttctccttgtgtctgtataacatctgtccaggatcttctggctttcatagtctctggtgaaaagtctggtgtaattctgataggcctgcctttatatgttacttgaccctattcccttactgcttttaatattctatctttatttagtgcatttgctgttctgatttttttgtgttgggaggaatttcttttctggtcctgtgtatttggagttctgtatgcttcttgtatgttcatgggcatctatttctttaggtttcataagttttcttctataattttgttgaagatattttccggccctttaagttgaaaatcttcattctcatctgctcctattatccgtaggtttggtcttctcattgtgtcctggatttcctggatattttgagttaggatcttttttgcattttgcattgtctttgattgctgtgccaatgttctctatggaatcttctgtacctgagattctctcttccatctcttgtattctgttgctgatgcttgcatctatgtttccagatttctttcctaaggtttctatctccagctttgccttgctttgcattttctttattgtgttcacttccttttttaggtctagtatggttttgttcatttccatcacctgtttggatgtgttttcctcttattctttaaggacttgtaactctttagcagtgttctcctgtatttcattaagtgagttattaaagaccttcttgatatccttgaccatcatcatgagatatgcttttaaatccgggtctagctttttgggtgtgttggggtacccaggactgggtgaggtgggagtgctgtgttctgatgatggtgagtggtcttggtttctattagtaagattcttaagtttgcctttcgccatctggtaatctctggagttagttgttacagttgtttctggttagagattgttcctctcatgattctgttatcctctatcagcagacctgtgagactagatctctgactttcagtggtcagagcacacttcttacagggaaggtgcacagatatctggcattcggacctccctcctggcagaagatgaaggcccgaaagaggacctgtcccaaaagctgttttgctttggcctgtcacctaagctgttaacttctgtaatccatactcacacctacacagactagtctcagagggacccgggaatcaaaatacctcccccaggtgctccagcatagccctccctggcagggtggacacctctcctctggcagggaaggtgcccggatctctggagcctgaaacagggtctgtctcagaagctgtctctagggaccttggagtttccacctactctgtgcccaggtgaccaagtgctggcactgaccggaagggatttgtgaccctggtcagtccgggttttctgcttctctaatgctgtctcaagtcccgtgcaattggattggaacagaagttgtattccactcaccagtggtcctaagatcacgtggagagtcctctaggggaccttgggggtgttttaaagtacatttaacaattccttttgcatttccctttgcaatgtagaatttgacttgtgaaaaaaggatattacttaatcaacatcatatttacctaaaggctattacttaatcaatatcatatttacatttattggaaaataatagaatgtacaagcatttaaaagcaggaggcttttcgcatttttctggttgtactttcatttgtacgttcagcaggcatgtaaatcaccaaagcttagagttgcataaaagagctggaatgatacttctctgttttgaattatgatacgactctgcaagaggatctcccaaaactcatgtaaggaatctcaaaactctattactgcagatttagaaacataaacaccctttgaaatctatacacacctacatataggctcataatacacatacaggcacacatacacacacaaaaaaagatgcagacacagaaagaaatatgcacacatggttaacattaataaaacatagctaactgtggtggctaacaacttctagcatttaacagtcagaagctgataaatttctgagttcaaagccagcctgatctacaaagtgggtttgatttagcaaattctaattagtaagatcctgtctaaaaaacaaaaccaaaacaaacaagccaacaagcaaacaaataagaatgtcatagcaacaatttgtaaaatataaggaaaaaatgcagcactgaatgataaatcaatgctttcattaaacaacaaagtttatgttcatggtaagggtggcatttacatgaacacataggaaattttaaaaaagacacctaatcttatagtatgacaattatttagtgctttgtacattccctagtgtaggttacattttgcataagaactctttcctttgtatagagatctaaacatgaatataaatcattattgtacaggcacaattgtccacatagcaccttcactttattcctgaccaatttatacagggatttatgaagaacctcctttttcatactagcaatagaacagcttacagctcatggccacctgcgtttgtcattagctttagaaaagatttcgagtccctgcagactggcaaacatgcacgcatgcgtgattggagggctgtgcaggctcactagcacagaatgggggttgggagtgtgattagtcaagtcagtgcagcaggtcctgctcagagaagaggcaggcaaacatgcctgtcacatccaccctaggaatggtcagcaaggcaatgcagcaaacaaggtcagctcccactttgaccccttgtttctttcacagtagaacatgatttgtgcacattaagtactgcaaatttattgggattagaacattattctatagatctcaatctttagctaaagaatcagatgagatcgggacctggcttcctttgtcctgtcctgtattatgttggctgcagtgctcctccccttgagccttcaatctgccctgtcacttcagctcagttctcttacagggtgaaaattaacatttcaaagagctgacagtattgtggattattggtgtgtgggactaagagccatcagagaaatagaatatttttatttgtctatgaaagttagatgaaaataatatccttaagggaatctaaattaggtactgtcatgctctgaaggatgggatgggataattgcacttgagcatttacaaacagattattttcagaggaaagacacaacagataatggtagtttgcacctcccagtttctggatgcatagaaggatcaagtacatatgagtttcaacactatgatgcctataataaaagaaagagcatccaaagtgcttttgagaaaaatagtggacaaagttaattcaggtgtgtgaactgccaatttgtggaaatgttgtgtgtcattacatacagatatagcttacatagtggtatagaactataaactttttctgtcattttgtaagttgatgtatcttgaatattgttaaactgcttcagtgtcattagatagtagggttggttttttgtttgtttgtttgtttgtttttttgtaatcttacccagattcaaaaataacctggtgaattaggaagtactttctttggacatttaatttatacttcatgctcgaatctcctgattttgattacatttatcagttatgcaaagtagcatgaagaatttttttgttttttgtgttttggttttggtttttggtttttgggttttgttttgttttgttttgttttgttttgttttgttttttgtttttagagacagggtttctctgagtagccctggatgtcctggaactcactttgtagaccaggctggcctcgaactcagaaatcggcctgcctctgcctcccaactactgggattaaagtcgtgtgccaccatgcccagctgcatgaagaatttttttgaccatactctgacagataaattcacatgatgtgagagaccaaaccgtgggaaactaggtcctgccagtaactctcaccctaaagatccggctgaccctttgaagggaattatgtcactccctccttcattgtctccacctggtgcctgagactgccagcttcactccctccttcactggcgcctagaactgcttagattacggcagcttcacctcctcctccatgtctctttttggtgctctggactgtttcatcaggacaggcactccaagataaactgcagaatgtttgaaggccgcccgggactgttagggggctgacattccaagataagctatgagaagcctgtaataagcattcgccccagatgtccatccctttctctgtattttattatgccccctcgacccctccctattttatctcactgtatgcttataatcaggctcctagccttcattaaacagaccttgacaacactttgcttggtcttgctcccctttctccacccacttctcttgtaggcctctgtcctcctggacccacagaataactaggtcctgctggacgggacaatatgaatgtgccttgctttttgtttttgtttggttatttaaaggtcttattgaaattgtattttagttttcatttcaaaatgatgttgtattttttacaacagttataacaacttttttattagctattttctttatttacatttcaaatgttattccctttcctagttttccctctgaaaatcccttatcccctccccacttctcctgctccccaacccacccactcccattcctggtcctggcattcccctatactggggcatagaaacttcacaggaccaaggacctcttctcctgttgatgaccaactaggccatcctctgctacatatataactagagctaaagttccaccatgtgttttctttgattggtggtagagttccaaggagctctggggttagttcatactgatgttcctcctatagggcttcagtccccttcagctcgctggccatcttctgctacatatgcagctagaggcacaagctctgggggcactgcttagttcatatttttgttcctcctatagggttgcagaccccttcagctccttgggtactttctctagctcctcaattgcgggccctgtgtttcatctaatagatgactgtgagcatctgcttctgtatttaccaggcactggcatagcctcacaagagacagctatatcagggtcatttcaacaaaatcttgctggtgtatgcaatagtgtctgcgtttggtggctgattatgagatggatccccaggtggggtagtctctggatagtccaacctttcatcttagcaccaaactttggctctgtaactcctttcatgggtattttgttccctattctaagagggaatgaagtatccacaaatggctaagatcaaaaattcatgtaacagcagatgctggtgaggatgtggagaaagagaaacattcctccattgctggtgggattgcaagtttgtacaaccactctggaaatcagtctggagtacccaatcacaaaagaaggcacttgatatgcattcactgataagaagaaggaagaccaatacgtgaatatttcatctctttggtctatcttcttgattttcatgtgttttgcaaattgtatcttgggtattctaggtttctgggttagtatccacttatcagtgagtgcatatcaagtgagttattttgtgattgggttacctcactcaggatgatatccttcagatccatttgcctagtaatttcatacattgttttttaatagctgagtagtactccaatgtgcaaatgtagcacattttctgtatcgattcctctgttgagggacatctgggttctttccagcttctggctattataaataaggctgctatgaacatagtggagcatgtttccttatcacaagttggaacatcttctgggtatatgcccaggagaggtattgctggatcctccagtaataatatatccaattttctgaggaactgccagactgatttccagagtggttgtataagcttgcaataccaccaacagtggaggagtgttcccctttcaccacatcctcaccagcatctgctgtcacacgaattttggatcttagccattctgactgttgtgaggttgaatctctgagttattttgatttgcattgccttgatgattaaggatgttggacatttttttcaggtgcttttcagtcagttgagaattctttgtttagttttgtaccccatatttaatgggattattttattctctggagtccagcttcttgaattctttgtatatattgaatattagtcccctatctaatttaggattggtaatgattctttcccaatctgttggtggcctttttgtcttattaacagtgtcttttgccttacaaaagctttgtaatttcatgaggtcccatttgtcgattctggatcttacaggacaggccagttgttcttctgttcaggaattttttccctagtgcccatatcttcgaggctttttcccaccatatcctttataagttttagtgtctctggttttatgtggagtcccttgatccacataaaagtaattttatacagtatattattattaaagtttcccttttatctattccacctagcgccttcccacatacccttcctttcacattagctcttttcctatctttccctagaaaagcacatacaataaacagcaatcaaacttatcaaaatgaaatataataagatcaaaagacattatattgagagtggacaaggcaacccaacagaagaaaaagtaccacaggtacaggcacaagaatcagacacctacttgttaatacactcagaaatgccataaatacactaaaataaatgttatttccacagaggacccaagtgcagacttaggctctggatgagagaggctcacatagtcatgtccttctttgtctctcattgtattttgttttttacttcaaaatgttgtttagatttaagatttttttctttttttaaatttatttatttttattaggtattttctttttctttttttttaaatattttttattattacatattttcctcatgtatttccaaagtggaattagatggtgactcatgccagcagcactctgagtttgtagcttctcaagcagtgctaattaatgcagttatggatcagtaagcagcataccatacacattgtctgtagcatacatttaaatatggtatgggaatatctcttgcaactctttattttgcaactcttttatgatttaagttttttctacagtgagaattttgtttccatattcataaatttacaattttaggattagtttgggtgaagtattttattgattcttatattgaatgtgcatcattattcatgctttctgagatcctttgacttatattccctagtggatgaatccttgtatgtcataagatttttataataactcataccttcttggagtagtatttgcactaaattagatatttctgtttaaacgaccatcaatatatatgtacatatgtaaaattaaatctttatattatatgtaaaaataaatattatatattacttatacaatatataatatattacaataaaatattatgtaaaataaaatatataatatgtaaattctatgattatcatatgtaatataatatataataattcaagactaaatgaaatacttaactacaaaatatagcctagttgtacttcttgagtatggatatatatatatatatatatatatatacacacacacacatatatgtatatatataaaatgaatatatgtacacaaacacaaatatatatatatattatataatacataaggtacactttacatacatattttatatatatatatatatatatatatatatatatatatatatataatatttgggaaaactatatatatatatccatataaatatctctacattttcatcaagtatagttattttttatattttgtagctataggtagtttattgtttattataatacatattatactacatattataattataaaaattgtgttgtaaacattcatatatatataaataagtatatagctacaataaagtacttaggtacttcatataacatatacatatatatgtatagctttcttaaaatttttcatatatccttagttttgcttaacacaatttacttatttcacccaacttcaacatttatccccattcctgatagaacatgtagcttccagtactctttttatattattttatatagcatatacatgaatgttcttacttactattatgttaaatagtataagctagtatataatctcccaaataacttctatatgtacatttcacttgattaaaccttgctgtggactctgattttaccaaatcctatctgtcctagtcagggtttctatgcctgcacaaacatcatgaccaaggagttggggagaaaagggtttattcagcttacacttccatactgctgttcatcaccaaaggaagtcaggactggaactcaagcaggtcccaaagttccacagtcctccccaaaacatggtcaggttgtcacaggaataccccacgatgatggtaccaattcccaacaatggttcagtagtagttgtgaatggaagtccaatctagcaataatctaccagttactcagtcccacatggcaagcaggcaaaggagcgagagcgagactcccttcttccaatgtccttatatggtcatcagcagaaggtgtagcccagattaaaggtgtgttccaccacacctttaattccagatgaccttgaactcggagatctccctgtcttaatcttctgtaatccatagccactatgcctcaagatctccataccaagatccagatcagaaatatctatctcccagcctccagattagggtcacttgtgagccttccaattctggattgcagttcattctaaatatagtcaagttgacaaccaggaatagccactacactatcatactactatccacataaatcttctggctccagaaatcccctttctactttcatttcctagatataatactcccactcctctctaaacatattcctctatgctaatgactagctttcagtatcatattttcacatagcctccatcaaacctcccaaaacaaaagtccttatgtaggcacctcgtatggagagaaaggggagcatttgtcttcttccggtttgattgatagtactcactgttactggttcttttcctttccatctatccacctgcaaatttcaatttttgttattgaacattatttaactgcatatggacacaatatatgtctaaaataaatatataaaaagcattttcataataaatattcactctgtgtgtgtgtttgtgtgtgtgtgtgtgtgtgtgtgtgtgtgtgtgtgtatgacacacacctaccaacagtacctatgcaaagtcagaggagaaaccatcgtaagtttcttttctcctattgtcttctgagatatacatatttactaaggatcacttatggagaaagaggagagacatctacatttttcatgttcaaattattcatatatgtacatatgtgtgtaatgaatcgttatgtaaggagcattgttagcattttcattttctgaaacatttataatatctttatgttgatgaatttcttttttttttttttttttttttttttttttgaagttagaaaagtcttttaagtttttaaattaaaattgcaccctgtccgggacccgccgaacttaggaaattagtctgaacaggtgagagggtgcgccagagaacctgacagcttctggaacaggcggaagcacagaggcgctgaggcagcaccctgtgtgggccggggacagccggccaccttccggaccagaggacaggtgcccgcccagctggggaggcggcctaagccacagcagcagcggtcgccatcttggtccgggacccgccgaacttaggaaattagtctgaacaggtgagagggtgcgccagagaacctaacagcttctggaacaggcggaagcacagaggcgctgaggcagcaccctgtgtgggccggggacagccggccaccttccggaccagaggacaggtgcccacccagctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggaccggaggacaggtgcccgcccggctggggaggcgacctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctttgtgggccggggacagccggccaccttccggaccggaggacaggtgcccgcccggctggggaggcggcctaagccacagcagcagcggtcgccatcttggtccgagacccgccgaacttaggaaattagtctgaacaggtgagagggtgcgccagagaacctgacagcttctggaacaggcggaagcacagaggcgctgaggcagcaccctgtgtgggccggggacagccggccaccttccggaccggaggacaggtgcccacccggctggggaggcggcctaagccacagcagcagcggtcgccatcttggtcccgggactccaaggaacttaggaatttagtctgcttaggtgagagtctgtaccacctgggaactgccaaagcaacacagtgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagaaatggaagagagaatctcaggtgcagaagattccatagagaacatcagcacaacaatcaaagaaaatggaaaatgcaaaaagatcctaactcaaaatatccaggaaatccaggacacaataagaagaccaaatgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatataagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggacaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaactagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggtcttttggtatagcattggaaatgtaaatgagctaaatacctaataaaaaatggaaaaaaaaaaaaaaattgcaccctggtgcgatgactctaatttgggaactcatccaaaggcagactctcctgagtgctggtcctctggcctggacacacagagactgggagcctgtcggacagttagaacagggaaggggcagaagcacccacatcagagggcagccaagtcttgacatctagctggtgacaaggtgacaagtttcagagtcaacaagaggccaccaccagcagagatgaaaattgtctaccagcaatggggtagaagtccatgattctgaggaccctcctgggtgcacctcctttggcggtggggcttcctaatggctggcacgccttctcacagagcagcacagccacgcggctgcaagctcgctccatctgtgaacacccttttgttcccctcaattgggcagagaaagaggtgctggcaaggaatgtgagccttgcctctgacaggaacacgtgtgcaggccccactctcacaaacattagctaaatttatattcatatatattatagttatatattaaaaagaggaaaaaaaaactttccctaagagaaactcctgaagaacccaagtggctcaggacgtttactgtcccccccccccccaaaactcttataaaatcttccagtgcgatcgtgaagaaaccccccgccctcttgcgttcctcccctcccagccctcatctgtgtccccacaaccctggactgccccctgctccagcccagtggcgtccagtctcatctctggccatccatggctgccatggctttctgaggggcgcccccctgcgatgctctggggggccacgtgggctgtgggcagtggagatggaaggtgttgggggaagagggcgggatccagggcacctggtgattgggtggggatgcggcccagaaggggctgaagtttgcagggggggaacaggccacggctgccatggggctgctgctgctgctctgcaggccctcagaggttcgaagcttggagaacatggccaatgcatcagggaagttgggtggtgtagcaggggtgttgctgggggtacacatcatctgcgggtggtggtggctgttgggaatgttgctttcttgaaagaacgtgcttagggcggtctcgaactgccagtgcgccgcttgcagcagctgctgcgcctgatcggccgcgcagcccgcggccagcacgaactggttgatcatgacctggtgccgcagctcgtccgtgttcaccgacatggcgctgggcggccgccccgggctcacgctcgcagctccgccgccgcccggctcgcgcggccgcgccgacgccgcaaaccatgttgatgaatttcaatgcactccccagatgactcctataggatgctgaaagatgaaatatctaacaacaatcagaaagtagttagaaggaagagagtcagcacaagacttttaattgtagaacccactgcacatgatatatttccaccagcaaggatacaccagaaaaaccatacaaaagaaatccaccaactaggaaccaagtgttcaaataatagaatctgtgaggaacatttcttattcaatctatcagaactactccctgatctttgcctgccaatccagttcaacctctctcatattcttcaggaaaatatcatggcccttgtcaccccattaaccaaactaaaggctgaaaaggctgagggctgggcaaataatatctgtccacagcttaacttggtacaggaatagacaaactgcacattctgggatatatatttgcctacccgtaggacaaagaaaacctataaaaatattttttcagcaaatagtgttctcattgtgtagcccagattaatatgtgctgactaggtagacctagctaaactttacctcacagagattttcctctgtcttccctactctggagttaaagtcataatccaccatacttggcctcaatcttcatctttatcttctgaattatgtgatgttctaaaatttgctatacaaggttaaaaatctccccttaggttatgaatacagactttggctttttgataacatttccccccacgtattcatgaagaataccttgcaagatgaaatgcagtgggcaagtgagcttcctggatacagcccatggtttgctcaaatgcaatgggtgtaatttagaaaggcaaaccccagaagcttcatctttaaattgcttgtcactgctgctgtgccttttcatgctttttattgttgtattcttcatatatttagcagattgtgattggactggtgagaccctcactgcctataaaatggtgttattatccctcatgaaataacccacagtatgggacaattttcctgcattggatagttttcctgtagatcaatatgacagtcaactttcagaaactaatattgtatagataaatttatggtttaaaaaattcatttttgattaaaatagatttaagaagttagagaagaatatagaaagtttaagaaggtggtttaaaggggctggagagatagatcagctgtttagagaactgactgttcttccagaggtcctgagttcaattcgcagcaacaacatggtggctcacaacaagctgttatggggatttgatactctcgtctggggtgtctaaagacaactacagtgtactcatgcgcctaaaataaacaaacaaacaaatgaatgaataaataaataaataaatattttttaaaaaaagaaaatggtttaagttgtgttgccagatagatataataaagttagaattaatagcagattgtttataatcccttttagaatacttagagcagcagagtttagaagagaaatacagtgagctgttatttgttgcaaacatgtaactgtacttggaagacaaaaatgccttggaagtagttaatgattaaagaaaaagaaaaaagaaacatatcattccaggttggttctgaattgctagatcatttgctctatagagctagccacaggatttggtgtacattatgaaagacaaagatataaataaagaataaataactgtatcataagtacagagaatagatgattatttggtttggctgaataagacatgtgataaatgatgatctttttcttggtgagtacaaattgtcatgagttaggaataggaaaagacttgattctatatgtcgctttgcttaaactttgataaccaataagaaaagaagtattgctttggggttaagatgaagctgtggagagaagtgttggcccagtaattcaatatattttccttgagaaaaaagtgaactgagtaattaattatagagtcctcaagcagtcttcaggtttccctgtagtgtcaatagtactcttgaacacatttagtactcaagtctctcactggtccaggaataaacactgaaagagattttgccttcctgtgcaagtcctggttccctattggtagttttggatttcatgaagtttaagtcccatgctagtgtaaaccctttgatttttcttcctccactgactaagtaatgatcttaatattccattggggcatgaaatattaatttttataatctcagttactatggtaatgcatgactcccttgtgttttccactacctgataatcatgtggaccttatactgtaatggccaagtagatatacggttcttacaatgaagagactcatttaacacaggttttagagctctagtctcaatgaggactgatttgtatatcacctggatttctaattcccacaacactcagaatgcccatatccaatcccaggccatatagtatcatgaggtcagtttaaatagactctattatttttatttataagttctccaagtggagtatagtgataaagcccaccttttagcctagtttgtatcactactgctatgtagtacagctagaggtcaggaatgttgattccacccaaagttatcttatgttcaggattgtttgtctgtcctgaattatttttccatatgaagttgaaaatcattgctagagatttttatatatttgtttaatgtacttgtttgtgatatagattccagatatctagtttaggtctctaagcttgtataataggtacttaaatcaccaagatgggtcattggtgcatttccattaacagtattgcattaaataattaaatgcacataaggcaattaccatatcatcctggtaatatatgttcatttttatggttacttttcaggacaatatccaacaagtggaaatgggcgtcatttccttaaaacgttgttagacatattcaattaatttacttcaaatgatcaatgtaatctattttttttaaaaatcattttacttacttgacattttattatctatgttttactttcaaagacccacaggctgttgtaaatggacacaactaccatgaacatataagtaaatcttcaacctgtttttattttaataacattatggaaaacttcttacaatatatattatataccagggtatatgattgtgacttgaaacacaaccagtattttgaaatctgctgtgtcgcttacatggaagaaaagcatgagttatgccaaaatcctgataatggaaagaagttgcactgtgaatagggaattattctgtcacaaggaactgagcctgtgtggaagagtctgttttctccaataaagtgtgtaggatatagaaaaatatttgtaattaagatatttcttttggtttccttcagaaagcatctaggtttcattgctatttgcagtaaaaaatggtgtgttttgacttattggagtgcttgttattggaaaatctagcggcctttgcttttccatgtctgggttacatgacatggcatgattatgtgttctcactcaattcacttctgttttccatttatttgtatatttattcattttacattacaatctctgatttctctcctggtctgccgttcacagggtccttccctgctaacctccttcctcttatattctgagagggtgtaggccacagtggatattcccctaacatgatacctcacgtctatgaagacaaggtatatcctctcccactgagggcaaaaaagaatctcagctaaaggaatgtattctacacaggcaacatatttagagtcatcccctactccagatgttctaggacccacatgaataatgagctccacatctgctacatatgtacagagggcataagttcagccaatgtttgctctttggttgctgattcagtctctaagagaacctagtatccaggttagctgattctattcagttttcagtggatttactatctccttcttagccctcaacccttccccaaaccttccataaaattccaagagctccaagcaatgttcagctttgagtctctgcatctatttctgtctcatactgtatgcagcttctcagaggaggtttctgtctgcaagcacagcagaatatcattaagagtgtcagggattggtgcttgcctatgggatatgtctcaagttggtcaggtttttgtttgtccattccctggatatatgttcaatctttgtccctgcatttcttgtacataggacatactttgagtcaaatgttttacatgtgggttggtctccttgtcactccacttacatacctgcctggacactggaaatacccctttcaagctccatattccacaagagaggaatttaaattgtaatacatccttatcttttctcttttgtaatttaactatctactggcctggatttgcttctgtcctggatgtgtcctgatgccttgttcaccaggctggaagggaaagaatgaatcttagctgggccagatggtttggagaagaaattggtctgtctgattattggattaacagccttctccagagatggttttcacctaaactgcttttctttatgggggtaagaagagttatataaacttttaggaagagattggagtttggaggtgtgtatgtattattagctgtggctgaactgccagggatgcttttttttttgttgttgttgttttttgttgtttttttttttttttttttttttttttttgcctaaagaagaatcccagacgcttactatacttaccttgttagtgagagaagtttacacagtaatttggctaccagactatgtgacacactcaaaagtgatggaggtggcggtcataaaacctatgttctctgggacaaacaagcccagagcaagatggaaaacagtcctactcctgctgattttcagtgacctcacacttactccagactggctcccccagacactcctttctgggcctaaaaactatcctctaaaatttccatactgaaactgactatgacaaaataatgggtcaaataaaattgttaattacagatggcttagcagtcaagagcaccaactgctcttctaaaggtcctgagttcaatatccagcaaccaaatggtgactcattagcttggttagtcacacgaaggtattttatattatttgtgacttttgtaaagggtgtcctttccctacttttttcttagcctgtttattcctagagtagagaaaggatactgatttgagttaattttatatccaggcactattctggagttgtttataaggtttaggagttctctgatgaaatttttgagtcacttaaatctaacactgtatcatctgcaaatagtggttgtttgacttttcctatacaatttatatccacttgacctccttttgttgtctaattgctctggctaggactttgagcactatattgaatcggtagggagagagtaggcagtcttgtcaggtccctgattttagtagaattgcttcaagtttctcttcatttagtttgatgtcggcaagtggtttgctatatattccttttactatgttttggtatgggccttgaattcctgatccttccaagacttttaacacaaaggggatgttgaattttgtcaaatgctttttgagcatctaatgaaatgtaggattttttccttgagtttgtttatgtagtgttttacattgatggatttctgtatattgaaccatctctgcatccctgggatgaagactgcttgattgccatgaatgatcattttgatgtgtttttggattcagttggcatggattttattgagtatttttgcatccgtattcataagggaaatttgtctgaagttctctttctttgttgcatctttgtgtgcttttggtatcagcgtaattctggcttcatagaatgaattggatagtgttccttctgtttctattttgtggaatagtgtttagagtattggtattaggtcttcttgaaagtctgatagaattctgcactaaaaccatctggtccttggctttttttggtagggagacttgtaatgacttcttctatttctttaggggtatgggacagcttagatggtttatctgatcctgatttacctttggtgtttagtctctgtctagaaaattgttcatttcatccagattttccagttgtgttgaatataggctattgtagcaggatctgaatatttttttttaatttctacacgttctgttgttgggtccccccctttcatttatgtttttgttatttgtgtattttgtctgtgccctctggtaagtctggctaagtgttcatctgtcctttttatttttttcaaagaaccagctcctggtattgttgaatcgtcatgtagttgtttttgtttgtttgtttgtttctagttggttgattacagtcctgagtttggttgtttcctgctgtctactaattttgggtgtatttgattctttttgttctagagctttcagatgtaaggtactactggggtaaactagttttttttttttttcatttggagaatttgtgaaatggagatactttcttggtattatttctgctctcagtgcatggatcccaaataactttgacctatacagaccctgtgcaagtgtcattctctgtaggatttcatatatgcatcagccctataatgtctggtaggagttgttaccttgttggcattgctccaaacaccattggccttagtgtcattctacaatgtattctacaaatttcactgagtcatgaaggaggagtttgcatagcaatatatgaattatgattggatgagccaaagtcttttactctgcacattgtccggttataggtctatgtatctggcctcatctaatgtatatattagcttctatgatgaaggtgcaatggtataatgaactatgggtataacagaatgtttgtattggtccatatcataagcagacaatggtacatgtttttaccttattctcaggtattttgccatgagaactacatcaaaaatgtattttgtctcatggagtagtcctctaatccagtcagatagtaattgcttaaccctcaaaagggcaactattacagcagagtatcatattggcagctgtcctgtctgtggcagatcaaagagtatagagctgggtttgttgtttaaatttcccctcaggaaccattcggaataattttcaatgccagcaacactatgcagaaggtaaaggttttagttaggcacctgcttatcttttctatgtttaataaaaatgtaagtgtaatctgcattagagctatcattggtttgtgaagagcaatcaacagcttaggcaatattctgagttgtgtgggaggtaacgggtaactcaggatgagttttttctgctgcatttctctgagttttattactttttaacagtttagtaatattccattgtgtgatgtaccacattttcattaaccatttcctcatttataggcagttaggctgtctcttcttcctactaatatgaatatacatgcaatgaatagaaatgagtaagtgtctatatagtatgatatggacttcttttttttggagatatgcccaaaatattataccgggatattgaggaacaacattcccaggttcccaaggcaaaatcacactgacttccaaaagctgaactactgtgtatttcgaccagcagaaaataaggattcttattattcatcatcctcccttgcacatatggtcatttcttttattgatcttccccatattatttacctaaagattaaatatcaatgtgccttgaatatgcatattgctgattaatgagaatgttgaacatttcttttagtgaaataaacatttgaatggtcaattatgtgtcattagaggaggagatttatagttgaatataaaaaggataaatagaggaaagccatggaaattagaggtacagaggacattagtattcagagagaaatcatagcaagccagactaccaaaacctttaagacatacttcagactaggatattaagcaatattacttcgtgtgtgtgtgtgtgcctgcaaatttgttctttagtatcataagagagcccagcaggctgataaatacaatgtttttaatgaatttaggaaacatctggttcataagtcaaggaggagaaactctgaaggtctaagcatcatggacagattttttttccatagggaaaaaagcatgtgataggaaaatcaaagagcctacagcaaagtaaattgtcattaaaagtgtattctcagggcagaaactctctttacttctcctagatcttagacacagaattccttcttgccattaaaaccacaagtcaagtgatacatgaaggcatgattacctctgtgttcatagtgccatgtagcttttgagtaaacagtaagattgatggaaaaaaaactacagaaagttctttgcagaatgcagatggatagggactatgaaatgactgtgcaattttcaaaggacttaaacagtcatctcatagccaaattcaatccctgatatctataagggacatctaaggtatgttccacttctgagatataggaagaataatacaggacactgttatctggcatatcacattacactacaatttatataacaaagagggctttattagacagtgttgaagctgcttgctctttaaaatatcccttcattgggagagttgccacatttaattttctcagccaacatggaagagacagtacttctggcaacggtaattgcaaatacctcccacagtgatagtcattatgacctctggattgacccaggaaatgtgcttatttttttcattaggactgagcaagtagctttgtacaggtgtgttgtggggcttaggggtccttctgaatgatcagaagcaattttgtcaacaggtggatcctgttagcttctgaatgctggtagtgctcagaagtcagaatgaagacaggcacattccatgctaggtttcttttgcatgagaacaaaacttttcttccttttatcaaccactcctcataggatgattgcttatcaaaatcgtccaacttgttgtaaagcccaaccaaatcattttttttcctctttgttgttcttgttttgtttttcatagaaatcccagtttgtgagagactaggtgctaaacttcaactctaggaagaaaatcacaaagtctacctgagcaaacatcctatggaaacccaccccaattagcaacagccagtcaggctacaatagcagagtcaaggtatatatagataatctacgagatcctgcagagattaaataatttagacatcctgctcatcaggtggtttttgttcccaagtttatttcttgcagagtacaccagaaatacagtttttaaacttgctgactcatatgaaaattcccccaagtttgctgtaaccactataaaaatcctgaaacccttgactgaggactctcactgcgacatgcttttaaagactttgatctagagcacacaataaagacccttatgtatttaaatgggaatcagctccaatatggccttttggggtctctgcaattatttaccttgtttgttgatgttgaaatttgctttgtaactttctaccaatgcctgataagacaagcctttcctagaataaacataattctgttcctaaagttttttgcctctcatatatactcagatgaagtttggccttgaaccaaaatttttaatttttgttcttcaatattagttgtattcaatttctattgtcttatatttaaaattttctatcatttttcatctgtttattttctcatttattacatcccctcatttccctcaaaccactccacgcagatctcccaataactttcctctaacccatatccatttctcctcccatttccttaaaaaaataaataaacaaataaataaataaataattttaaaacccaaataaataaaataaaataaaatttaaaaaagaggtggtttcccaagaatgtgtgagaaagatgggaccttagcataaaaagtaatagtaaggctaggaccaaaacctctcatgaaggcagaggaaaaaaaatgagcaatgtaattgcttctggctgaaataattgaaaggattctttatgacagatggtatgtttctttcttaataaatatttttaaatctcatttttagaattttctgatgagtggatttagaaccatgccaattcacaaaagatgctttctatacaataccaactaatataaagccacattaaagctgagaacgtccttttccttttagtaccctcagcaataactaagatcctatagcagtggcctgctccagtcagtaggaaataagtcataaaagcacagtgctgtgcagtgccccgcctccccatcccctggactctagcgacagaaaatacagtgaaactacaaggaccaaagttcctttaggttttcaacttcctcaggcaccaagcattgaggtgaccactgccttcattaacttactgtgactccagaaaagtgattttcttttccattttcacgatcaggattgcctcctttgaaacaagaatttgcaattactattgataattcaggatttcgtcatttgaatcatgattttggatttactactgatgatacaagtctcacctttttacaaatgctctgtaaataaagttttgcttttgtaaataaggaattgaagagttcagcttaatttcagggataacagaagtcaccagtcacttcgcttagttttaaaataattttttttcatgtacttttcagcagatacataggatgttttcttttttcttttcttgctttccatttttttttcctttcttaatgaaaatttaaaggtgattctttaaatggaatggggatgtctaacacaggacatgctttgaattctgcatttcatatatatatatatatatatatatatatatatatatataccaaaaatatatctaaataaaagtgggagacaaattttataggaaatacttgcttcagtgacataatttgtcctcaagtattatgccaattacagagtatgagagtaggtctcagttacttttagcaatttttttccattttttaattaggtatttagctcatttacatttccaatgctataccaaaagtcccccatacccacccacccccactcccctacccacccactccccctttttggccctggcgttcccctgtactggggcatataaagtttgcgtgtccaatgggcctctctttccagtgatggccaactaggccatcttttgatacatatgcagctagagtcaagagctccggggtactggttagttcataatgttgttccacatatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatgggtacatctacacaatggagtactactcagctattaaaaagaatgaatttatgaaattcctaggcaaatggatggacctggagggcatcatcctgagtgaggtaacacattcacaaaggaactcacacaatatgtactcactgataagtggattttagcaatttttttcatttaatattcattcctcttttttagatcgtcatttaagcagtttgttatgatagcaagagaaacttcaaaatagtcttctggtggagacattttgattatacctgagtacagcagagggtcctgactattcatttacagccaaagagcaaggggatggaaaataagtattcaggaagaaagagagaaggagaaaaggtaggaggaagagaaggaggagaggactccaataatcagagacaaggaaaagctcaagaaacttgacaaaaaaaaaatattatcacaggtaaattggaaatctatgctatggaaggaggggggttgtaaaaactgaacatatacaagttagtcttctgtcaagaaaaatgacaaaagcaacaagtacacaattctttatattcccagatagtgtaccctttatccttttgattaattttaagatctatttattccacactgcttcaactctcctaaatgcccgtgttaagtaaccattgaatttggccagtgtaaggcctctacattatactaacatggtaatcagtacccagaactttatataattatccctgatagcactatcaattatagaattggaatcaaatcacagattatgacatcacagtttaatctgtatagtataataccatagactactgcacacatatcacacagattttattcttagattctattgagatggttattctctctctcaacttgatgtgatctagaatcacctgagaggcaagcctctgtcatccgtgagcagggttaacttaattcagggaggagaacctgtcctttttggaaggaccaggttaaggatccttaacactggcctcttccctaataaatttgctttctgggtcccaggcaagaactctacaacacaaaaaagagatgttgataattttgcatatatatccacaattactagttacttgtatgattaaaaactgcaattcatttttaaaaacagggattgctttaggtattttccgtgtcctaatcccacttttacacacagtgttttgatagctgcagaaaggcatggattctttttcttatttagctgaccttacttgatccttgacttttgtttctactgtataaaatcatgacaggatggccattatataaaaacctttaaacttaacctactagatggcaaataaagatgggacactgtatgtttaaagccagtctattctatacagcatcatccttgccagaaagagctattaatacaagtattttctttaaaaataataagccaggcactggcatagcctcacaagagatagctatattagggacctgtcagcaaaatcttgctaccatatgcaatagtgtctgtgtttggtggttgtttatgggatggatccctggatggggcagtctctgggtggtccttccttccatctccgagctatgccagtgcctcacaaatacagaagtcatctattgggtggaacacagggaccccaataaaggagctacagaaagtacccaaggagctaaaggggtctacagccctataggaggaacaacaatatgaactaaccagtaccctcagagctgtgtctctagttgcatatgtaacagaggatggcctattcagccatcaatggaaggagaggcccttgatctcgcaaagattatatgccccagtaaagggaaatgccagtgcctggaagtaggaatgtgtgtgttgtggatcaaagtgggggaagggtataggggactttcaggatagcatttgaaatgtaaataaagaaaatatctaataaaaacacttgaaaaaataataaatcagtcatattaataagtcttaataataagtctgtcttattattgagtattttctgccaggcatcctctgacaattttgacaaatataacactatggtgttgtagtttcactgtctctatatatgaactaatattgaaaggtatctttataattcaagatggcagaagtattctttcagcaaagtttaaatttctccagcacttgtagaaacttcagagggactgaagtagcaaaccaatataagggtgggcacccccttggctcagtatgtacaaattgagataataccatacttacctggtcattcctacattgcagcaaatttcgccacactgggattgcttctgaaaattcttccatgggatatgaagtgagatattcccatgtgcattcaaaggcaactttttatttttgtgggttacgttcttccatgatttcatattgcataatgcatatttttcaaattcaatgtatatttagcaattcctaatccattttcctttcccatgtagactttgacttgcagaaaaaaatattacttagtcactatcatatttacatttattggaaaataattgaatgtacaaacatttaaaatcggaaggctttctgcacttttggttgtactttcattttcatgttcagcaggcatgtaaatcaaaaaggcttaaagttgcatagaagagctggagtgatggtgctgcttgtaaaaacagatactgccctgcaagaggatttcccagaattcatgtcaggagtttcaaaactatgttactgaagatatggaaacataaacatcctttggaatgtacacacctctacacataggctcccacatacacactcattgcacatgcacccacacacacacaaacacacacacatacaggaatggagtgggggatggaataaacagtgactgagcaatacacagagacataaatgtagacagagagaaaaatatacacacataatgaatattaataaaatctagctcaccacggtagctcataactttacatctagcacttaatggacaaaagctgataagtttctgagttcaaagccagcctgatctataaagtgagttctgagttagcacattctaatgagtaagaccctgtccaaaaaagaaacaaagaaacaaataatacgaatctcatagcaacaattttttaaaacaggaggtaaaatttcatcactaaatgaaacaacaaattttatgtacatggtaatggtttcatttacatgaacaaacaggaaatttaaaaaatacacctaatcaagtaaaatctcattaagccagaaggttattaaggcagcattttttattccttactaatttcttctgatattatgacaattatctagtgcttctgtacatcccctagttggcgttatattttttttcctaagcaccttttctttcccttttatagagatctaaaggcaaatataaatcaatattgtatagtcaccattgcctacaaagcacctttattttattcctgactaattttcacagcagtttatgaagaccctcctctttcaaactagcaataggacagcttacagcttatggccgcctacttttgtctttagctttacagaagattttgaatccctgcagcctggcaaacatccacgcatgcgtgatgggagggctttgcaggctcactagcacagactgggggttgggagtgtgattagtcaagtcagtgcagcaggtcctgctcagagaagaggcaggcaaacatgcctctcacatccaccctaggaatggtcagcaaggcaatgcagcaaccaaggtcagctcccactttgaccccttgtttctttcatagatagatatgatttgtgcacattaagtattgcaaatttgttggggttagaacaatgttctataaatctgaagtctttagctaaagaatcatatgagaaagctatgagatcaggacctggcttcctttgtcctgtcctgtgttgtgttgtcttcagtgcccctccccttcagccttcgatatgctctgtcacatcagctcagttctcttagagggtgaacattaacatttcaaagaactgaaagtattgtgaattattggtgtatgggagggagtaagagccatcagaaaaaaatagaacattcatgttggtatgtaaatattacatacaaataatattcctaagggaaaatgattaggttctgccatggtctgagggatgggaagggatcaaagcacttgagagttaactacagattatcatcagagagaagacacaacagttaatggtagtttgtacctcccagtttctagacagatagaaggatcaggtacatatgagttttgagactatgatagttgtaatacagggaggtacattacaaagtgccttttagaaaaatagtggacagggttaattcaaagtgaactaccaatgtgtggaaatgtggagtgtctttacatacagagccatagcatacaccgtggtacagaattataaacattttttctgccatcttgtaaggtgatctattttgaatattgttacactgcttcagtgttgttaggtactagttatttattattttttgtaatcttgcccagattcaaaaataagctggtggattgtgaagtactttctttggacatttaatctatactttgtgctctaatcttctgattttgatggggtttatcagtaatggaaagtagcatgcagaatttttttgaccatactctgacagataagttcacaagatattccctgctttttgtttttgtttgtttgtgtacaggccttactggaattgtatttttctttttcatttcaaaattatgttgtatttaattttattgaagataaattttagtttcccttttttacactcctccagttccttcccacataacctaccttccacattagctctttttctgtgtttcactagaaaagcacacacaagagataacaaccaaacatatcaaaatgaaatataataagatcaaatccatcatcctagagaatggacaaggcaacccaacaaaagaaaaagtgccacaggagcagccacaagagtcagagatccacttgttgacacactcaggaatgccatataaatactaaactgaatgttataacatgtacaaaggacctagtgcagaatactgtgggtgctggaagacagaggttcacagagtcctgtctttgttttctctcattgtgttttgtttttcatttcaaaatgttaggatttaagattggtaaggtatttccaaagtggaatcacgtggtgactcatgccaatagcactctgaggttgttgcttctccaccaatgtcccctgggagtaaaccaccaatcaacgaaaacacatggtgggactcatatctctagctgcatatgtagcagaggatggcctagtcggccatcaatgggaggagaagcccttggtcttgtgaaggtttttccagtacaggggactgccagggccaggaagcatgagtgggtgggttgggaaacaggggtagacggtagggggtaggcgattttcagagaagaaactgggaaaggggataaaatttgaaatgtaaataaaatatctaataaaaattcatgcagttatagaacagtaagtaccataccatataccttttgttactttaactctgtagcataaatttaaatgtggtttggtgatatctcttgtaaatcttttattatttaaatattctctagagtgagatttttgtttccatataaagttacatttttaagattaatttgggtgaagtatattgttgattcttatactgaatatgagtaattattcatggtttccaggagtctttgactaattccctactgaattaatccttatatgtcactaaagtatttttaataactcatatcttcttggagtagtatttgcactaaattagatatttctgtttgaagtactgtcagtatatatgtatacacatataattaaatatttatattatatgcaaaaataataaacattatatatagtatttatatgtataacatgtaaattttatcaatatcatataaaatataataaatataatttataataaagtagatacttaactgcaaaatataccctagcaaaacacctagccccataccttatagaacatgtagcttccagttctcttgctatattattttatataacatatgcaacaatattcttactattgtcttagagagtataatctggtatataagttcccaaataaattctctatgtatattcacttttgctacactttgctgtggactctgatttttccaaaccctatcataccactatcaacataaaacttctgcctccagaaatcccctttctactttcatttactaagtattatacgcctgcttctctgaaaatgcatttctctatgccgatggctaatttccaatattgtatttttcacatggcttccataaaaccacacaaaacaaaagaccttacataggtgcctcatatggagagaacaaggagcaatggtctttttcagatttaattgatattactcactgctacttgatattttcgtttccacccatctatctggaaatttcatttttttttctgttgaacattttttcaatgtatgttttttttttaaagaaagcattatggtattaattactcacatgtgaatgtgtgtgtataaagcatgtaccaacagcatctatgcaaactcataggacaaactcttgtttcccactgtttgttttctaagatatacacatttacttaggatcctttatggaggaactagtggggagagagaaggagaggaagaaggagagggatcttatttctttttttttaatattattttttaatttaatttttacacttagtatttcacttcctgacccccaaacacactccaactgttcgacatcccgcatctcttccccttcccaccccatctccatgtagatatcccacccaccaccccacctgacctctaaactccgcggggcctccagtctcttgggggttaggtgcatcatctctgaatgaacacagagccagaagtcctcttctgtatgtgtgctggggccctcatatcagctggtgtaggctgtctgtttggtggcccagtgtttaagagatcttgggggtccagattaattgagactgctggtcttcctaaaggatcgcccttcacctcaacttctttcagccttccctaattcaacaacaggggtcggctgcttctgtctatcagttgagtgcaaatatctgcatctgactcttttagctgcttgttgggtctttcaaagggtagtcatgatagatccccttttgtgagtgctcctagtgtcaggaatagtgtcaggccttgggacctcccctttaattggatcccattttgggccggtcactggaccttcttttcctcaggctcctctccatttttatccctgtaattccttcagacaggtacaattatgggtcatagatgtgactgtgggatggcaaccccatccctcacttgatgtcctgtcttcctgctggaggtgggctctataagttccctcttgggcatttcatctaaagcccctccctttgagtcctgagattctcttacctcccaggtctctggtgcattatgggggatgcccccaacctcctatttccttaggatttctgtttacattctttctgctggtcctcggggcttcagtccttttccctcacccaataccagatcaggttctccactctgccccactccccccacatcccatccacttttcctctaagatccttcctccctcccaacttgtgattgctttcttctctctcccaagtgggactgaggcatcctcacttgggcatgtcacttggttcctaagctgtggatttgtttggtatggtttcgatggtgtagccttgctggtgtaaatacatttcatgcagtggtttctaagattaaaagtcttgtgaatttaagttcatcaacacaaagatattataaatgttccagaaaatgtaaacactaacaatgctccctatttaagcattcattatatacatatatgttcacattatggttccatcacatatgtataatttgtagatgaaaacaagatctgaaatgcatggtatatactcactaatacgtggatattagccaaaaacaaacaaacaaacaaaaaactgtaaataatacccaagatacagtccaaagaaagcttgttgtgcttttttaattcttttattatgagtacataccaagcatgtgagatcttgttgatgaacttcaattcactttctaatcttgataactggtttagggtgctgaatgatcaaatctctaaatacaaccaggcagaagaaagaatagatgataaacactcattagtgaggagagagccagcacaagacttttaatcttagaatccactgcatgcaatggattttcaccagcaaggctacaccatggaaaccacaccaaacaaatccacaacttaggaaccaagtgttcaaatactagaatttgtgaggtatatttgttattcaatctatcagaactactccctggcctgtaatgcctgccaatctagttcaactactctgatattctctagaaaaatatcatggcccttgtcatcccattaaccaaactaaaggctgcaaaggccaatggcttggcaagtaatatcttcccacagcttaacttggtgcagacaataaatgaacaccacagattcttgcatagataattggctacccttaggaaaaacaaaatcatttttaaaaatctttcagtaaatactgttcccgttgtgtagtcctaactaatttgtgctgattatatagacctggctagtcgttacctcacagagattttcctctgtcttccctattctaggattaatggcattttcagtacctagcctcaatcttcatctttatcttcggcattatttggcatatacgtcttctaaaacttgtgatggaagcttcaaaattttctattaggttaggaatacagatactggctttttgataacattgccccccaagacacaatgcaggataagatgcaatgggcaagtgagcttcctggtttgctcaaatgccatgggtttaaccacagaaggataatctgcaggactttgtctttggattgtttctcactgctgctgtgtcttctcatgcttttcattgttgcatttttcatatatttagtgtggtgtgattggactagggagaccctcattgcctatagtttgctgtgattgcctcttgggagagatcccattgcattggacaatgtttctgtagatcaatgtgaaggtgaaatttcagaaaataatattgtgtggataaacttatgattttaaagaattaatggttcaatttaagtatatttgaagaattagtgtagtttatagaaagtttaagtctatggtttaatgtatgttcccagaaagatgtaaaaaacttagaattaagagcagattatgtctcattccttgtaggacagttagggctacataggttagaaaagaagtacagtgaactttcatttgctgcaagcatgtaattgtagttcgaagcaaatgatagccttggggattagttagtgattaaataaagaaaaagaaaaaagaaaaagaaaaaaaaaagaaacaacatatcatttcacgaatactttcccctatggatgtaactacaggatttgaggtgaactatgaaagactgggttataagtaaagagaaaatagttgtgttatatgaaaagagagtagatgattattcagattagctgaataagacatgtgataaatgactatttatttcttggtgaatacatattgtcatcatatagatacagaaaaaaaacttgctatcgactggtttgcttaaactttgataatcagtgagaaaagacatattgctttggagttaagatgaaattgtggaaggaagtgccagcccagtaattcaatccttactcaagtgaacttagtaataaattactgaatcttcagccttcaggtttgcctgtagtgtcaatggtactcttcaagacattcacttactcaaatctcacactgctgcagaaataaacactgaaaaggattttgtctgccttggaaagtccctggagctctattggttgtttttgaatttcatgaagttaagtcctgtgctagtctaagccctttaatttttcttcctccactgactggtctcagaaggctatgccaagtcacatgtgaccctctaggtttgctttgaaagtttcaagaaacctgatagctagctcatcatcaaccaccctgctgtcacttgacactgtgacagtgataagctggtgctgctgcagttggggttcccccttcatcctcagtgagcttcagcactgggtggaatttcccaacttccaagattcaggactgaggcaggttaatcactgcagtgaactcattgatgccaaatatccacaagttggaaatactaaaagatcctccttggtactcctccggcatcaattttccatctcttgctttcttcaacagaaccttaacagagtcagcgatcttctatatgcccttagcggctgcatcttttatgattggtgtaattaaacctttatctgtagccacagcaattgaaatgtcaacagaaggcagctgtttggtccttctccattccaggtgacattaaacccaggcatttgtttaacagtaacagctactgctctgatgataaagtcatttactgagactttaatgtcatttttgaccagatcgcatctaacctttaaaactgctccaagttcatggtcagcagtagcataggcatgaggcacagtacttttgattcagttaacctcttagtgataacttttagaatatttctatcaggaatttcagtgaatgtacccactgcattaggttgcccagcgatggatactggtgggattgttgcccaagggtaagatggcccagctgtagcctgaggaagaacaaatgctgagagagaggacagaggagctgaggttggtctaaattcagtaatcttgcccaactgtttcagctcgactaacttgagtgcaccttctttaatgaggattccacgagggctgtgccctggctggcgtccaatgaatgttttttccagaatgttgcggggcagctggacttaagcagaactgtggtgtccctttgtgttccttcctgtcagggctaggaatctgtggctgtggagggggttgacaggttttgaaactggaggtggagcactggtatgtttgggaacgctcacatttccaatcttccccttctttaaccatcaaagcaatgatgtgaacccagctgtatatttttagcaccttcctcaaccactatcttgggtaagatgccatcgttgtttgcatcttagatgaccatggccttgtctgtctcaatttcacataatgagtctcaagaattcacagcttcgccttcctttttcagccatttcataatgttcctttgttccattgtaggagacagtgatggcattaggaccttaataggatctgcctgcagtagctgagtaccgtgaaaccatctccaacttgctccacggccgacaggccaagcagaagcaccctgagccagtcccaggctttgacagctgctgaagcccagaaggtaaggtagcagcgccagattatagcaaagcctccaggaggccgccatcttcccagccttctctgggaaagcttggaactcaactaaatctttggcctcaaggcccgcccaggcccctattctaatgaagatattttaacatcttactttccaatctgtgtcacatttttctccttcactcttttttttgcactaagattcctaataatataataagagggaggagtaaacatccttgccttgttccaaaaggttatcattaatatttatcactatttatacaatgctgacccttaccttcttatgtattttctctctcaagtcaaaatatgttctctgtatccttaccagtgaccacatctctaaagaaaagtgacacttgctcacccagcagccatcaatgctaatgcccccctggtatatgaccaaactatagatgaggacacatttaatgtacttggaggttttagtggtttttcatttatgtattgactagcactaaaggaaatatgaatcatgtataaccaaaccccgagaacggcacaaatcactggatataatcagaaatatctttgtgtgtgtgtgtgtgtgtgtgtgtgtgtgtgtgtgaaaatgaccatttagaatagcatcaaatcattttatgctaggacctacaacctccattgtcatgtgttttaaatatgtttgcagtgcaatgcctgatttttcaccctgtgaagaaagcctcaattgcaataaagaaagtggttgtgtagttctataaacaatagactctcataaacaatttgcctcttttgtcattattgcagcctgcaatgtccaacaagagataaaaaacatcattatcttttgctaacaatctcaataacactgtcttgtagtagtaaagttagctaaaagaatctatttttctggttagttcaagcttggtatttttcatacggtgagcacagaaatatgtgacacgttcaacaatgtggtcttttcattttttatggggaacagaaaataattacactagcctattattattagatgccttttcatttctatgactaataaatcctacaaagtaatctatgtttttcaataaaatttatattttataacaaatagagtcttgatcttcactctgattcattgcatcaggatcattgtccgcagaaatgatccatgacaatctgtgcaatcttgattgcttatgaatctaacatttggattacagatttgtcactagtagtattaaatacacgagttaaaaaaaaatcttcattttgttggaaaagggtttattttatctgaaaattctcaaatcacacaccatcactgagtgaagacaaggcatttactcaaggtaggaaatggagacagggacttaggcagaagctgtaactgctgcttaccaatttgcttcctgtggcttgctaagaatgattccttatacacagcaagattacctgaccaggtgtggtaccacacaaagtgggctggtcctcagacatcaatcatcaatcaagaaaatgactcatagacttgtatacaggcaaacagagttcaattgagattctttatttccagataactcagcttgagacaaggtaacaaaaattagcaagaaaaatatggacatgtaatgtacataacacatattttatgtattacagaatttatctacataagtgagatacatttttgatcagtgaatcagaattcaaagtccagaaacaaaggaaaattcaatgaacagttgattttacacacaaaactcacaacaaactaatttttctaacttttattaaatatactaatacatatttatttataaacctttcaagatgccaaattaaaattattttaatgcacttttaaaacacaagaagaatatacatctctctttaggttaaggaagtaaaatgcctgtctagtgtgctggagttcctgagttaaaaccccagtgtttcaatgaaaaataaatttgaggcaacagtgaatgggtagagaaggtgaaatgaactccagtcaaatcacataaccaaagtttcatacaggaaagcatcatggcaaaagtagagaactgacttcctcatgttttcctctcaccaaaaagttgcatactccaaaaagtagattcacttcattttaatgttttaagaggaatgaacatgaaatctatatttgttttttaattactaatttttgaaaatagaacttttcagaccatatattctaattgtgtgccactccattttttcctacctgattcttgacacctccataaccacctaaatcttcatgttctctctcccatttagaaaacatacaggcaaacaaacaaacaaacaaaaaaagctaaccaacataaaacaaaaccaatatccaaaggaatcagaaaaaaattcacaagaagcacattcatacagagagacatatgtccacatttaaaaacaaattaaaatacaaaatttaaagtcataatgtatgaaaaaatcaccagtatggtgaaaagcacagtacattatgaatcaacaataataatcccaaattattgttgattccatgaaatgtctgtatactacatggaatgaggattctgtatcttcatgtggattctgcacccagtaaggtacttctatagtgaactacttttttcatttggagaatttgtcaaatggagacacctccttagtgaggggtaggaggtcatattttatttctgttctcagtgcatcgacccccaaataactttgaccagtacagattctgttcatgtttcattctctgtaggagttcataagtgcatcagccctattatgtctgacaggcattattgccttcctagcattgttccaagcaccactggctttagtatcttaagatgcgtagtatcttagtattgttcttagtatcttagtacaatgtcttttacaaattttgctgagtcatgaaggaggagtttgtatggcaataagtgatttgtgattgggtcagtcaaggtcttttactctgcacattgtccagttatgggtctatgtacctggcctcatctaatgtatatattagcttctatgatgaaggtgcaacagtataatgaactatgggtataacagaatgttcttattggcccatatcataagcagacaatggtacctgtttttaccctattctcaggtattttgccatgagaaccaagtcaccgagtagtcctctaatccattcagatagtaatttcctggaatgggccactattacagcagtgtatcatgtaggcagctgcactgtctttggtagatccattagtatagaactgggttggtgtttaaatttcccctctggaatcatgcagaatgcttttcagtaccaccaacactattcaataggagaaggctttgttaagcatctgtttatcttctctatgtttaatagaaatgtaggtgtaatctgtaatagagccatcattggtttatgtagagcaatcaacagcttaggcaagagtctgagttgtgtgtgtgtgtgggtggaggagtactgggtatcttgctatgagttttttctgctgcattaaactatgagttctattatctttgtaacagctgagcaatattccattgtgcagtgtaccacatttcattaacatttccccaattatggggacatttctcttctttccttctaatatgaatatgcctgcaatgaataggaatgagtaagtgtctctatagtaggatatggactcctgttttggatatatgccccaaaataatacacctggatcttgagtaacaacattcccagtttccaaatgaaaaatcacactaacttccaaaagctgaactactgtgtatttcgacctgcagaggataaggactgctatgatcatcctccctagcatgtatggtcatttgttttattgatcttgcccatactacgttcttgaagattaaatctcaatttgctttgaatatccatatagatgaataatgagaatgttgaacttttcttttagtgaaaccaacatctgaataatggtcaattatgggtcattagaggaagggatttatatttaaatacaaaatgataagtaggggaaagccatggaaattagatgtacagaagacattagtattaagagaaaaatcatagcaagtaagacaaccaacacctttgacatatttcagacaattatattgagcaatttcacttcctgtgtgtgtgtgtgtgtgtgtgtgtgtgtgtacaaattggttctttaatatcataagagaggccagggagttgataaacaaaatgttgttactgaatttaagaaacatcaagttcataagtcaaggattagaaactatgaagctctaagaatcatgggcaaattttttgatagggaaaatcaaaacagtgtgataggaaaatcaaagagcctacagcaaaggaaattgccattaaaaatgtattctcagggcagaaactctttagttctcctatatctcagccacagaattcattcttgcctttaataacacaagccaagtgatgcttgaaggagtgattacctctgtgttcacagtgtcatttatcttttgataaacaagtagattgatggaaaacactacaaaaagtttttagtagaatgaagatggatagagactatgaaatgactgtgctcttttcaatggatttaagcagtcatctcaaagccaaatcctatccctggtataagggatatctaaggtatgttccacttcagagacataggaagcataatgcaggatcctgtaagctggcacatcacattatattcaatgtaacccaatagttaaagatcaatgagaatcctgtgaggctgactgagttttaaaaaatgggtggagagaaatatttgccaagagaatatacaacatgcagatttaaaagagaaattgatttattaaactattgtatatacttatacttcatcctgtataggtgcattttcttccacatattatttcagttacaatacaattaatataacaaaaaggactttattaatcaaagtgttgaagctctttacaatatcacttcactgtgagagttgccacatttactttcctcagccaccatggaggaggcagtacttctggcaacagtagttgcatttatctccttcactgatgctcactaccacttctggatttacacaagagatgtactctttttcattagggctgagaaaatagctctgtactggggtgttgtaggaggttaggggtccctctgaatgataagaagcagttgtgtcagcagatggatcctgttagcttctgaatgctggtagtgctcagaaatcagcatgaagacaggcacattccaccttagggttcttttgcatacaggactaaacttttcctccttacatcaactacttctcttaggatgattgcttatcaaacttgtcaacatgttgtaaagcccaaccaattctgttttttgttgttgttggtggtggtggtagtggttttgttttgtttgttttgttttgttttgttttgtttgttttattgtacaaatcacattttgagagacctggtactaagctgcaactccaaaaagaaaatcacaaagtccacctgagcaaatatcctatggaaacccacccctcttagctaatgacaatcaggttgcaatagcagagtggaggtacatatagataacctaagacatcctgcagagaatagataacttagacattatactcattaggtggttttatccccatgtttcattcctttatgtacaccagaaatacagttttaaagcttgctgacccatatggaaattccccaagtttactgtaaccataataaaatcgcaaacacccttgacttggggttctcactctgacatgctctgacagaaattgagggagaccccgatctagagctctgtaaggtgggcataacactgtaacccaccacttcaaagggtctctttcccttgcttgtcgatgttgaactctgctttgtaactttctaccaacagctgataagagatgcctttccacgaataaacataattccgttcctaaagtgtgttttccctctcatagttactcacacggccttgaaacaatttttttttaattcttgttcttcagtatcgtattcgatttctattgtcttacatttaagattttcctatcatttttcatctttattttctcataaattacatctcatttcccttaaaccactctacccagatctccccaatatctttcctctcacccatacctactcctcctcccattcccttaaaaaaaacaaagaaagaagaaagagagagagagagggagagagagagagagagagagagagagagagagagagagagagagagaggtgatttcccaaggatgtgtaaggagaatatctgaccttagcataaaaacttacagtaaggctaggaccaaaacctctcatgaaggcttggtgaagaaaccatcagctatttaatttgttaacaaatatttttaaatctcagttttagaattttctgaggagtggatttagaaccacgccaatttgcataagatttctacacaataccgactagaataaacccacattaaagctaagaatgtccttttccttttagtaccttcaacaataactaagatcctatagcagcgtcctgctccagtcagtagacgtgctacaggaaataagtcataaaagtgcaatgctgcgtagtgcctcgcctccctggtcccctggactctggcagcagaaaatacagtgaaactacaaggaccaaagttcctttaacttccccaggcgccaagcattgaggtgacctctgccttcattaacttactgtgattccagaaaagtgatttcaactttcactggtgccaagtaaagaagtgacacctgccttcattaatttactgtggttgcaggaacacatcactgtggtttgcttttcctgtttttatgttcaggattttgtagtttgaatcatgattttgaatttactactcatagcacaagtcccatttattttttaatctccttttcttcagatatagatttacaaatgctctgaaaagaaagttttgcttttgtaaataaggaagtgaagcgttcagctttatttcaggaattacatgactctgaattttgaaagagtttgatatatcaacactgtgggcctttgtaagtccaggacagatgtttgatattcaacctttagaaatgtacttttctaacataaacaaatgtgagttttatcttcatcccaaatataagttagattgtaaacacagtggattacagcatgcaagaggtaaaagcagagaaaagacaatatatactctgtgccattatatgctggaaatacataacttgcttttgattttatgggtattatattgaaagtattgacttgaggctcagaagacaccttcatctattaaacaatattcattttatgaaagatgatggggtctttaaagttgtataataaatatttttattatgatatgtttgtgagactgtgagagacaaagtgtagagtgcagtgatttgaatgagatgccaactattagtctccaatttacaaacttttgattacaagttgatgactatttgaagaagattaggaaatgcagcattgctggacaaaggatatccctgggaatatttatttttcaaaaatctcttgatgtgtcaaatatgtctctctgcttcctcactgtagtctgagatataagttgctaattcagcaaccttctgcttggcagtcaagatacagaaagactgaaaataatcttttgctactacaattttattttattaatatatacttgttgttgttactaaaggattcccaaatgtaatcctgtctttattaaattcaatgcagattctctgtctgtgtctctaaagtattagacttaaaggcatgtgccaacatgactgttcttttatcacaaaagtatttaattgtaaaataattaatattcaaagacagatgcacatttcaaaatgaaatagaaagcattcagtatatagactcacatgttcaattacatcattcaagagatggaagcaaaagaattactacaagtttgaggccactctaggctatagaatgaggcaccatctcataattttcaaaaataaaaaagggtaggaacaaaagaagtcaagtaaaagagaagaaggaggaggaagaagaggaggagaagtagtagtaggagaaacaaaggaggaaaaagggaagaggaggaggaagagtaggaataggacaaggagaaaaggactcccataatcaaagacagtgaaaagatcaagaaacttgagaaaaatgattaatacagatgaattagaatttagtgctatggaaaaggtgggagttagaaaaactgagcatatacaaattagtcttctgtcaagaaaagtgacaaaaacattaagtacacaattctttatattcccagatagtgtaccctgtatcctttctttaattaaacaacaaattttatgttcatggtaatggttacatgtacatgaactcataggaaatttaaaaaaaaaaaaaaaaaaaaacacctaatcaagtaaaacctcattaagtcagaattttgttaaagtaacatttttacctcttagtaatttcttgtgatattacaacaattacctagcaattttgtacattctctggtttgggttacatttgtcctaagcactcttaatgtcttttgcatagagttctaaaggggactataagcattgtgtagccaccaatgcccacatagcaccttcattttattccttaacaatttttacaggggtttatgaagacactcctctttcatactagcaataggacagcttgcagctcatggctatctgcttttgtcattagctttaaaaaagatttgaatgcctgcagcctggcaaacatccacgcatgcgtgattggaaggctgtgcaggctctctaaaacaggctgggggttgggagtgtgatttgtcaagtcagtgcagcaggtcctgctcagagaagaggcagccaaagatgcctgtcacatccaccctaggaaaggccaggaaggcaatacagcaaacaaagtcagctcccactttgactccttgtttctttcgtaggtagacatgatttgtgcacattaagtattgcaaatttgttgggattagaacattgttctataaatctcaatctttgactctgaagaatcagaacagaaagctatgagatcaggacctagtttccattgtcctgtcctgtgttgtgtctgctgcagtgcccctccccttaagtcttcagtttgtcctgccacttcaggttgaacattaacaagttgacagtattgtggattattggtgtgaggaactaagagccatcataaaaaaaaaaaagaatgtttatattggtatatgaatgttacataaaaataatatgcctaagggaatttaaattaggttctgtcaagctttgaaagatgggaagggataaataaaatgaagatttacatacagattatttttagagggaaggtacaacagataatgatgggtttcacttcccagtttctgaatgagtaggaggatcaggtacataagagtttcggcactatgatagccataatacagaaagggagattccaaagttcctttgagaaaaaaatagtggacagagttaattcaggtgtgtgaactgccaacgtgtggaaatgtaggatgtctttagataaagagctgtaacataaacagaggtacagaattataaaccttttttctttcaacttgtaaggtgatctattttgaatattgttaaactacttcattgtcattaggaactagttattttttaattattttttaatcttgcccagattcaaaaataaactggtgaattgcgaagtactttctttgggcatttaatttatactttgtgctctaatctcctgattttgattggatttatctgttatgcaaagtagcatgcagaatctttttcatcatactctgacagataaattcacaagagtgtgtcttggtttttgtttttgtttgttagtttacaggacttattggaattgtattttttttatttaaaaatggtattgtatttaattttatagaaaattaatatcaatacagtattattattattaaactttcttttttctactactcccagttccttctcatataccctaacttccagattagcttttttctgtctttcagtataaaaacacagacaagagataacaaccaaacacataatcccagccacttgagaggcagaggcaggcagatttctgagttcgaggccagcctgatctacaaagtgagttccagaatggccagggctacggagaaaccctgtctcaaaaaacaaaaaacaaaaacaaaacaaaaacaaacaaaacaaacaaacaaacaaaacatcaaaataaaatataataagagcaaatccatcatattgagagtagacaaggcaacccaacagaaggaaaagtgccacaggagtagggacaagaatcagagacctacttgttaacccactcaggaatgccataaaaacactaaaatgtatgttataacatatgtacataggacccagtgcagactattgcagtctctgtaagagagaggtccacagagtcatgtcctttgttttctctcattgtattttgtttttcatttgaaaatgttgtttggatttaagactggtaaggtatttccaaagtggaatcatgtggtggttcatgccaacagcaccctaaggttgttgttactcaagcagtgttaattaatgcagttatcaaaaagtacgcaccataccatataccttttgtttcttgaacactgaggcataaatttaaatctggtatggtgatatctcttgcaactcttttattatttaaatttttttctacagtgagacttgtttccatataaagttacattttttaagattaatttaggtgaagtatattgttaattcttacattgcatatctataattatttatggtttctgggattcttagacttatattccttagtagattaatacttgtatgttactaagatttttttaataactcatatattcatgaagtagtagttacattaaattagatatttctggtggaactactatctatctatctatctatctatctatacacaatattaaatctttatattataggtaaaaataataaatattttatacatacagtatttatatgcatataacatgaaaattttatgattatcatatacaatataacataataattcataaaaaattagatacttaagtacaaaatatagcctagctatacttttttggagtatggagatatgtatataatatgagtatgtgtgcacaaagacaaagctttgtacatatatatatatatgtatatatatatatatatatatacatacatatatatatacacatacaacttatatataatatatgaagtacactttgtgtatatattatagatataaaatatagtttatagagacagatatatatatgtatatatgtaaatatacatataattatatcaatatctccacattctcatcaagtacagctatattttattattatatatttagtatattaagtattatgttacatattatactacatattttaattataaaaatttattttatgtgcatttatacatgtaaataaatatatagctataataaagttcttatgtaattcatataacataaatatatacatatatatgtataggtttcttaaagattttttatacatcctcagttttgcttaatgcaatgcacttattctacccaactttaacacctgttccaaatcctgatagaacatatagcttccagtatgctttctgtattattttacatcacattacttactattgtgttaaatagtataagctattatataagttcccaaataatctctatatgtacatttcactttggataaaccttgctgtggactctgatttttccaaaccctatcataccactgtctacataaaacttttgcctccagaaacctcccttttactttcctttaccaagcattatactcctactcctctctgaatgcatttttctatgccaatgactaaattccagtatcatatttttcacatagcctccataaaacctcacaaaacaaaagaccttatgtaggcactgcatgtggacagaacaagcagcactggtctttttcagatttgattgacatcattcactgttcctggctcttatcatttccatctatctatatgtaaacgtcatttgttggtattaaacattatttaactgtgtatggacacaatgtatttctttaaaataaatatatgaaaaacattttcatattaattattcacttgtgtgtgtgtgtatgcttgtctatcgtaccaacaacacctatacaaagtcagagggaaaacctacacaagtcccttttctcctactctttgttttcttagctctatacatttactcggggacatttaaggagaaaaaggagggatatcttattttcatgttcaaactattcatatatgtgaacatatacatgtgtgttatctagggagcattgttagcatttgcattttctgaaacaatatctttatgttgatgaacttcaatgtatccctcagatgatcactggaataggatgctgaaagatcaaatatctaaatacaatcagaaaatgattagatcaaagagagctaggacaagacttttaatcttaaaactgatttcctgtgttgtgcttcagcaaggcctacaccaccgaaaccacaccaaacaaatcaaccacttaggaaccaaatactagaatctgtgagatagcccacaacatgggtcaattttcctgagttaggtagttttcctgtagatctatgtgatggtcaacttccataaaataatattgtgtagatgaacttatgattttaataatgcatttttgattaaaatagttttaaaagttagagtagaatatagaaagtttaagaagatggcttaagttgtgttgccagaaagatataataaagttagaattaagagcagattgtgctccattccttatagaatacttaggactgcataggttagaaaagtgtacagtgagctcttatttgttgaaagcatataattgtacttggaagacaaaaattgccttggaagtagtttaggattctataaaatgcacaatatagttctttcaataattaatgtctgaatcttcatcatgatatttttcaataagtattattctgtatatttcaaacttatttatattatttcagacaggaggattttttttattcctttagaatcatggaatgatagggaggatcatgaattacacggataggcagtagagaagatttagaaatttggtagaaaagcatcaaaatatattgtatgacaaacaaacatgtttaacaaggatgatgtcactggaagagccaaacccatgcagataacctcataaagcctcaaccttatacaaaatgttataagtatatgtaaggagttgggcatgtgagaggtggactttgccagggataagtatgttaattggtggatcaatgccaaatgttcaccactgaaaacatagacatgtaacattatacagactgaacaggttattaacaagaaaactcatggatatatgtgtgtgtgtgtacataaatatatgcatacagtaatttggttgtgggaaagtatcattaatttaatagactagagggtgatgaaggaatattttgagagagggaatggcaaatgtatttatttcatgaactaaaaacatattaaaattatatactttacataaaaatatgtcattgtttgaactcatggaagatggatcagctgtagaaggggcatgctgccaagtcagaaaatttgaattcaatctctgagatccatttgatgaaaagagaaaaatgcttaatttaagtaatacttaacactttaacatgtggacttgaaatttgtgtgtgcatgtacatgtgtgtgcttaaccatgtgtgtttctgtgtgtgtgtattttatatatatatatatatatatatatatatatatatatatataaaattatagtgcaattatattaaataaataagctgcatttttttattttttattaaatattttctttatttacatttcaaatgttacccctttcctagtttcccctcagaaaaccccctatcccttccccctccccttgctctccaacccactcactcccattcctggtcctggcattcccctatactgagacatagaaccttcacaggacctaaggcctctaatttgatttttttcaaactttgtgggtttgggttcatttattatgcataatatcatcttcaaatagtatatttaaaattattttaaaactgagccaggcatggtggcacatgcctttaatcccagcacttgggaggcagaggcaggctgatttctgagttcgaggccagcctagtctacaaagtgagttccaggacagccagggctacacagagaaaccctgcctcaaaacacaaacaaacaaacaaacaaacaacaacaacaaaatcaaaacaaacaaaaaaatgagacaccaaccaggcagcacacactagctgatatgaggccaccgacacatacagcagaagaggactgcctggtcctaactaaccctcaagagacttgagaccccagggagtggggagatctggtggattgggggcatgagggaatcattcttggagaagaggaggaggaatgggttgaggaaatgttggaggacgactaggagggggataacagctggattgttaaaaaaaaaaaacgtaaagaacaataagaagaaatgtattttgattttagatggttggtttgggtttcaaaacaggatttatctgtatagacctggctgttaggtttttgctctgtagatcagcctgttatcaaactcaataagattcatgttcatttcccttgtaagctctgtgattaaaggaaagtgcaaccacaccaggctgaaactgtatttagcctgcaaaatctctctctctctctctctctctctctctctctctctctctctctctctctctctctctctcacacacacacacacacacacacacacagacacacagacacacacagacacacacagacacacagacacacacactgggataatgtggatctatgtttttacacacacactcacacacacacacacacacacacacacggaaacagaagctagactagaatttactttgtacaaacatgactttgacctcatgatccccctgccaacaccacttgaatccaagtacaagaggtgtttaccactattctgtgagtatagataaccatttattttgggggggggcatactaggtaagaagtgtaaaatctatacaatgtcattgcactggttatataaatcacacttaggattgcaccccaatggccaataacaacatattgtacaaacaaatacatatgtgtgtttgtacaaaataatgtacattagcatatatatgtataataatttttttaatattagagggttggtttggtttttcaaacagtatttatctgtatagaaccagctgtccaagatcttgctctatagaccagcctagtctcaaactggctactctcaaattatacacacacacacagacacacacacaatttatatgcacctaaatatattagttactttcacccatctctgctttaattcaaaagatcaagaaaaaaactctacatttcatttttacatctcaaacttttttcaccttctgagaacacacccatatcttcagcatagctaaataacactcatgttcaactacaaatagtaggcctttcgagattcttctgttaagaattatctgcttagctatgtgccccattttttaaactgggtgatgtgctcatttgtgtttaacttcttgttttctttaataaattttggatattagtcctctgtaagatgtggggttggtaaagatcctttcacaattcctagtctcctgtttagttttattgatagtgttcttggccttacacaagctttgcagtttcatgaagtcccattttcaatgttgaccctggacattggagtactcttaagtaaattgtttcctgcaacaatgtgttcaaggttatttttagtttatcttgttttatgttgatgtccttgatccaattggacttgaattttgtgcaggatgatggatatggaactatttcactcttttacagtactcctcagttatactagcaccatttgttgaaggtttttttttttttttttggttattttgttgaaaatcaaatgttcctcagtatggggggttatttctggagtttttattctattttattgataggtgtgtctgttgtcgtacaaataccatgtaaattttaatcactattgctctgtaggacaggttgatgtcaggaaaggtgattgtttctgaagttatcttattgataaagattgttttggatatcctgggtttattgtttttccatgtgaagttgaaaatcattgctagagatttttatatatgtgtttagtgtactggttcattttacagaaacctctctccaagtatttctttcttataagccaacatgtttcaagtaaatacttaaatctccacttacattttatagttttatttctatagatgataaatttactaatttttatatttctatgatattaaatgtcctgttcaaaagttctatcttatgttaacgatttgaaattactcactacttactcctctattagattcaaggcatcatgtcttaggttacagtccttgattaatttgcagttgagttttggagggcaatcaataaagatctactttcacttgcctatctgtagctatccagattgatcagaacagtttagtgaaaaaaaatttttaatttttttcaacaaacaggtggctgtatcagtgtgggattatatgtaagttctcatttatattcaattgatcagtgttttaagttttacgtcatattgtgcagacttttgtcacttcagctgtgtagcacaatgtgaaaactggaattctgataattccttctgctttgttatacagggtttcttgttttggttttggctttgttgtggtggtggttgttttgtgttatattttctgtttgtttgtttttaatttgtttttttttttttttgccaaagtgaaacttcttgttcctatatgaaattacaattacatctctctctctctctctctctctctctctctctctctctctctctctctctctctgtctcagtcttttgagacagggtttctctgtgtagcctggctgtcctggaactcagtctgtagaccagactggcctcgaactaagaaatccacctgcctctgcctccagagtgctgggattagtggtgtgcaccaccactggctacaattacatttctaattgtgtataaaatgttttgttttagattgcattgaatgtgtgaattgcttatggaagaacagccatttgtaaatagctctgttattcctaagaatggaggccctttaggctttagtttcttcttcagtaaacttttctagtttcttaaattatcagtattgccttttgcattttagttgtgtgtgtgcatgtgtgtgaattgtgaatagcattgttttatgatttcttaaatattaactggattgtatatgaaacctatttaattatgtgtgttaaatttttatcctgtcacctttgctgggtgtatcagttgcaagaggtatctggttgaaaattaaggacactatattcaaatgaataggcacatcatattcaaatgaagaatctttaaactctgactttacaatctgtcatatttttctccttcacttttttgcactaagactcctaataatatagtaagtagaagagtagggtaaaaatccttgtcttgttccaaaacattatcattaatatttatcatcatttataccattctggttttaccttattatgtattgtctctcttacatcaaaatatgttcttagtatccttaccagtagccacatttataaagaaaagtgacacttgctcatccagcagacatcaatgctaatgccccccaggtataaaaccaaactatagatgagtacacattaattgtacttggaggttttttttgtttttcatttatgtactgaccaacactaaatgtaatatgaattatgcataaccaatccctaggaacagcacaaattgctggatataatcaaaaatactttttttgtgtgtgtgaaaatgaccatttagaatagcatgaagttattttattctaggacctaaactccccttgtcatgtgtcttaactgtttcccgtgtcatgcctgattttcatcctttgaagaaagcctcatttgcaataaagaaagtgcttacccagtgctataaacagtttcagcactactgcagcattggtacattttgcctttcttgtcattattttagccttcaagatccagcaagagataaaaatcagtaacttttctgttcctgacaacctgaatagcatattcaagtactatgaaagataagtaacagaaaccattttctggttagtgcaaacttgatattgtttatatgtctggcagatgaaatatgtgattaccttcaacaatgtagtcttatcatcatatttttaaagggaatagaaaataattgcactagcctagtatctttatatgttttttggtttctatgaccaataaatcctacagatgtaatctttgtctttcaattaaatttgtatttactaacacatagagtcttgatcttcactctctgagtcattgcattcgatataaggcctagtcctcagaaagtatccacaacaatctttgtaatcttaatatcttttaagtctaacatttggattacagatttgttactagtaaaagaatcattttcattttgttagaaattggttcatttcatctttttttgttttttaaattttttaatttatttttttaattaggtattttcttcatttacatttcaaatgctatcccaaaagtcccccacaccctctcccccactcctctacccacccactcccacttcttggcattggcgtttccccgtactgaggcatataaagtttgcaagaccaaggggcctctcttcctaatgatggccgactaggccatcttctgatacatatgcagctagagtcaagagctccagggtactggttagttcatattgttgttccacctagagggttgcagacccctttagctccttgggtactttctctagctcctccattgggggccctgtgatccatccaataggtgactgtgagcatccacttctgtgtttgctaggccccggcatagcctcacaagagacagctatatcatggggtcctttcagcaaaatcttgctagtgtatgcaatggtgtcagcgtttggaggctgctaatatgtgaccaagataaatttaagaaggtcagactatactgtagaatatgagaccaggaactgaactgagctttttgggtatcgtgatctgtctcattcgaaagaaaaaactctacagcaagaggactgaggctatatatgcctcagaaacaagcataatggaagttcagtggaatggcaattccttctgtagaagatactatatttgaatattttaaatacctcatgagtttgacttttaactgtctaaaaatgaggggaaaaacagtggaaataaactgtcctcaaaagtattatccaatgttttcaactaccatctttcctttgtggcttccattgataagcaggtatctcctaagttgagcagccttggtttctgtgttggcaaagactagggttcatttcatcttaaaattctcaagtcacatactaccactgagtaaataacagtcattaactcaaggcaagaattggaggtaagcagaagccatgatgctgattaccaatttgttccttgtggcttactctgaatgcttccatatacacagcagggttgtttgaccaggtttgggaccaaacaacatgggctgggtcgtcacacagcaatcaccaattaagaaaatgatgcacagacttatacacaggcaaactgatagaaacagtataactgagattctctgttcccagataactcagcttgagacaaggtaacaaaaattaacaagaaatatatgcacaatcagcttccaaacgctgacaccattgcatacactagcaagattttgctgaaaggacccagataaagctgtctcttgtgagactatgctggggcctagcaaacgcagaagtggatgctcacagtcagctattggatggatcacatggcccccaatggagaagcaaaagaaagtaaccaaggagttaaagggatctgcaaccctataggtggaacaacaatatgaactaaccagtaacccccagagcttgtgtctctagctgcatatatatcagaagatgacctagtcagccatcagtggaagagaggcccattggtcgtgcaaactttatctgcctcagtacaggggaacgccagggccaagaagtgggagtgggagggtgggggagtgggtgggggagcatgtgggggacttttggaatagcattggaaatgtaactgaaataaatacctaataaaaaaagaaatatatgcacatatagtgtacataacagatattttatacattacaaaatttatctacataattgatatatacttttgatgagtgagtttgaattcaaagtccagaattgaggcaaaatttaatgaacaggtgatttttcaaacaaaccctatcctacgacaacttaatggttttcaactttctttctttctttttctttaaatgtactaatacacatttatttgtaaaccttttcagataactaaaattacttttaatgcactttaaaatcatagaaagaaagataatataatctataaaatacttgaactgaaggacatttgtttataacttttccattagttaaatagatatacatcgtagtttttaactctatgtgtttatgtatgaattctatgtaagtttaggtatattcattaaacagtgtacctgtgaatgtcagaagatgatctttgtgagctggttcagtttcctcaatgtagattccagatatctaatttaggtctctaagcttgtatggcaggtatttatgatgccaaggtaactcattggcttgtttccattatcagtattgcattaaatagttaaatgcacataaggctagtaccacatcatcctggtaatatatgtgcattttatggttattttcaggactatatccaacaagttaaaatgggggtcaatactttaaaactttgtgaagcatgttcaatttacttcaatatattctaatttaatctttttgaaaatcatttaacttacttgacatcttattacatatgttttactttaaaagtcccacgggctgtagaatatgggcacaagaattctacaagaacaataaatatacaagtaataattttacctattttttattttaataaaaacaggaaaaacatcttacaatattataccagggcataaaatagtcacttgagacatagcaattattttgaaatctgctgtggctcttaaatggaagaaaagaacaagttttgttgccaaactactagtagtggaaagaaaatgcactgtgaatagaagaatgtgctatcacaagagactgtgtggaagagttttttttactccaatattttgtggagcttattcaataaaatatgtatttaagaaatttcttttggtttctttcagaaaacacataggtttcattgctatttggaaagaaaaatggtgtgttttcacttattggagtgactggtattgagaaacctagtggccctcacttatccatctctcaatcacatggtgtcttagtcagggtttctattcctgcacaaacatcatgaccaagaaacaagttggggaggaacgtatttattcagcttacacttccatactgctgttcatcaccaaggaagtcaggactggaactcaagcaggtcaggaagcaggagctgatgcagaggccatgaagggatgttcttgactggcttgcttcccctggcttgctcagcctactctcttatagaaccaagactaccagcccagagatggtcccacccacaagggacctttcccccttgatcactaattgagaaaatgccttacagttggatctcatggaggcatttcctcaactgaagctccgttctctgtgataactccaactgtgtcaagttgacacaaaactagccagtatacatggcatggcatgttctcactcaattcacttctttttcccattaattaagttatttattcatgttacatctcaattgttgaccttctcctggaatactgtttacacagtccttccctgctaacctccttcctcttatattctgagtgggtggaggccatccccctaccatgacagctcaagtctatgaagacaaggtacatcctctctcactgagggcaaaaataatcccagtcgaaggcatggactccacagacaggcaacagatttagggtcatccccacttcagttattctaggacccacatgaagcatgaactccacatatgctacatatgtgcagaggacctaaaccaagcccatgtttgcattttggttggtggtcagctctaagagaccccagtatccaggttagctgattctgttcatttttctgtggatttactatccccttattggccctaaacccttcctccaactcttccacaagattaccatagctccaagcaatgtttggctatggggctctgcatctgtttctgtctcatgatgtgtggagcctctcagaggagagtcatcctagctttctgtcagcaagcacaacagaatatcattgagagtgtcaggagttggtgcttgcccattagatatgtattaagttggtcaggttattgtttggccattccctggctccctgcatttctcatagatagaatatatttcgagtcaaatgttttgtgtgtggtttggtctccttgtccctccacttacactccttcctgaacacttgaattatccccttcaggctccatatcccacaaaaaaaggaatttaaattataacacatccttatcttatctcttctgtaatttaactatctactgtcctgggtttgctactgccctgggggtgcccaggcttccttgttcagaattctagaatggaaagaatgaagcttagctgatccaggttgtttagagaggaatttggtctgcaggagtgtaagatcaatggccttctccagagatggttttcagcgaaacagcttttcgttattgggtgtaagaagagttatataaacgtttcagaagagctaggggttctggggtgggtgagtatgaatcatagctgtggttaaagtgctaggaatatttcatttgcataaagacaaattccaggtgcctgctagacctatcctcatagtgagaaatttaaacattaatttggctaccagactaagtgactacctcaagggtgatggaggtggggccttaaaacctatgttctctgggaaaaacaggcccagagcaagttggaaaacagtcctactcttactgattttcagtgacctcacacttgctccacactggctcccccaagggcatacctttctgggcctgaaaactatcctctaacatttccatactgagactaagacaaaataattgatcaaatcaaattgttagttataaaacactaacaaaactattgttacttaagaccaatctttggtaaatttggaaatgaaataaactacccaaaagaaaaatactaatcctaaaataaggataaatgattttgcataccctacaattccaatatttcctaaaatataaataactgtatatacaatgcaaataacatagtcagtgttgataagatatgtgatggggtgataatcaaagggtcaggaaattgaacgaatgtttatagcaatgagggatggagaactgtaggtagccaacagaacatcccagatgccaggaaagcaataggttcccaggacccaacagggatgacattagccaaaatacccagcaaaatggagagagagcctgtggacaccatatccataggttaggcaatgcctccagttgaggaatgggaccacccactcatctctaaatttttaacccagaattgcacgtgtctcaaggaaatatagggacaaagtgtggaacagagactgaaggaaagggcatccagtgactaccacatatgggattcaatcccatatgcagacaataaacccagacactactgatgatgctaagaagtgtttcctgacaggagcctgatatagctgtctcctaagaggctctgctagagcctgagaaatacatatgtggatgctcacaaccaaggaaccaactgagcctggtctctaacacaggagttaggtgaaggactgaatgaacagaaggggtttctaaccccataggaagaacagcaatatcaatcaaccagacctcccagagttcccagagactaaaccaccaaccaaagagtacatatggagggacacatgccccagctgcatgtgtagcagaggatggcattaatgggaggggagacccttggtcttgtgaaggcttgatgccccagtatagggtaatgctagggtggggcggtaggagtgtgagggtgggaggtactctcatagaggcaggggaagggcggaagggataggtggtttccaaaggggaaactgggaaaggtattacatttgaaatgtaaataagtaaaatgtctaattaaaaaaaaagaaaaatgaagaaaatacctaattttttaaaaaatttaaaaaaagaaaaatactaaatttaaagctaggataagtgatgttgaatgtcttacacatccaacatttcaaaaaatattaagagctatatatacaatgcaaataatatagtcattgttgataagatatgcgatggcagaagcagaggaatctgtgggtagatagggtgtttgcttctctaaattgctattgttacttctcttattcatactatggtctttagtgttataccttcatgtgtaataatactgttcaaccattgcatataaatataaagtcacatacagcagaagagagtaataatcacacctggattgggaacataattaattttgatataatactggattttcttaatgccttcaccaattaattgtataccctgaattctgtctcatattatcagcttttaagaatgtttcctagaatcatgagaaatagaacattagactgttgagtgtacaaaatgtcatttttagtcaacaggggaaactttcaacgaagctcacagaaaaaaggaaaaagatagcatctaaatgtttaagaaagttgagtgacttctaagaactttgcaatatattatatttgaaatgctaaaggcctatatccaaaatatcttgggtgtttagtgcccttattagcaacttaacgaaatatctctcaattaacatactttcaattagatggtgaaacttttggaatttattataagagcactagctaaggaacagacaagtaaaacctaatatagacctatcaccaagtgttatataaaacctaaagtaggtattttctcattttttatacccctacagtagattttcctcagaaaagtacttgtaaaaccattagtatgtgaattatattaaaatgtagctatacaagtctttgtaaatactttagtgttggaacatatactgaaatcatcctgaatctgtgttcctaaatgctgacatccatattgagctaacagtaaataatctattctttttcttttcaagtaaaatttatataccaataaaatgtgtgccaaaatacttctaaaggtctaaactctctgtattctattaaacctaattcttactatgatactataagaacttatcactttaccctttccaatttgcctatattcgccttcccactgtaattgggaaaatactaccctagtttattttattattggatatcaaaatagatataaatttcttctaaaatattaattcaatttctatatgggaaattatatcaacaattatggtgaaatcataatgtgcaaataatttaatcatttgaattagatcttcatgatttctgaattccatcatttcctctcacttctactgtaagtaaagtgtcttcataattttcataagttgtaatatgttctatattctttaaccttcatcccaaatcttccaagtaaatttttgttcatttgttttgtttctatgttaagactgattacttgctattttggatttgttttattaattattatgtacccaaaattggtgagcacctgaattctgtctgacttagtggatcatatgttagcattacaggaatatagaaaatctccacacatttacatccatagtaaaaaaataaaatatgagtattaaaagtatttgggggatatggacttaaagttagagatttttattaaaaagattatttttccacaataatataacctgattacagttgttctccctctactaatcagagtccctgctcacatgtatttctatttttacaaatcttttctaagagctaaaattaaagttaaatgaaaataagaaattgccctaacacaaagcaagtattaacaacacaatgtgaatggacaaagcaaacatgcagaaggaatagagtcccaaaaaaaaaaaccacaagaaaaggagacaactaactcacatttgcaggaattccatagaaatgctaaaatggaagacataatatatacgtagagaaacaagtgcagacactctgagagttcatatgagctcagactatattgttaaagaaagccttgttttcttggtggtcctcatgtgttatggattttacactttctttttgcctcctctttttaatggttaccttagtgctgaaatgatggatttggtggagtgaataaggttagggatgagtgtctctagaacactcactctctgtaacagtgtgggtctctgtacttgttcccaactcatgaagaagccctaaagttaaatgagatgttagttgtttactcccacatgctttctttcaccattgcagtagcatatctttcaggcaagatactattgtaaatcaaatgatttatggcttgcttattgtgtatattcctatttcagtagcgtgtagacttcattcttgaaccaaggacagtagaacatgattggagggtgaggtgtgggctctaagtaggtacgagctcaacatctcatttttccatgagtttagtaagtgtaacccactcttcttactggaaagatcatttggtaacagagttatccgtttctacctctaactttcatattatgtggcaattccatttaatatacattcatatatgcatatattcatgaagggtctactgtttatttccatactaatcctcaaagggtccttatttttaactgtgtatccccatattccctcctctactcacttctccatttcactccttgttgttcctcttccaatccccattctgcctatccatatcaaattatttaatttccctgtcctatggagacctatctgtcactcctagtgccttactctaaacccaatctgttttttccagattagagtttgtttatcactgacttaatagcaattgtccacatataagccaactacatatcacatttatcttttggggtccggttttcatcattcagtatgataattcctagttcagttcatttaccagtcaatttcattaattcacttcttttaaagtatgagttttatggagcagtgatctttgtgatattgtggattttctttagggtatatgccagttgatctgggtcttcaggtagaactattttcaattttctaaggaaccaccagatttattttgagagtgtttgtaccagtttgcaatctcaacactcatgaaagagtgtctcagggactgatctagtcaccaacacagctttggattgatcccaggggtgggcacaaaactcttacactattactgatgctatgttgtgcttgctgacagtaagctagcatagctgtcctctcagagcctctaccagcagctgaatgagacagaaacagacactcacagtcaagcatcggactgaggttggggacccccatggaagagttaggggaaggactgaaggagctgaaagggaaggcaaccccctaggaagatcaacagtgttgactaacatggaccatgaaaactcacagagactgggccagcaaccaaagtgcacaagaaactggtctaaggccccaggcacatatagagtagaggactcccttgtctggcccagaagaggatgcaactaatcctgtagagacttgatgctccagggatgggggatgtctgggggagtaccctctcagagatgaaggggagagtggatgtgtgtaagaactctgggagtgggggtgggggagaccaggcatgggtaacatttgggatgtaaataaataaaataattaataattataatatttttaaaagaaaaaatacatgaaatttaccttgttaaattttatctgtaattccatcttaggcaaaaacttcaagtaactattgtttgagaccacttagattacaatagtcatgagaaatcctaggctgcagttttggactctgtatcaaaaacagcaaaagaactaataataaatcagggtagaattttacaaaggaaaaaaattttatttatctgagatatcagttaggcaaaagctgttgcaatcacttacttttacatgcctgaacaaaaggacagttcaaatgaaatcagatgattattagtgttttcaaatccattgagaaatacaggtgtggatcaaagtaaaaatgcatacttagcatgttacagttcctgagttgaaaccaaactgtttcaatgaagaataaatttgaggcacctgtgagtaggtagagaaggtaaagtgaactccagccaaaccaaattaccaacgttttagaagaaagcatcctggcaaaagtagagaattgatttccacatattttcctctcaccaatacaggtgcatcctcccaaaagtagattcaagtaattttaatgtcttaggatgaatgaacatggaatctatatttgtttttaattactaaattttgaaaatagagtttctcagacaatatattctgattgtgtgccactctgttttctcctacctgattcttgccacctgtataaccacctaaatcttcatgttctctctctccccttagaaaatatacaaccaaataataaaaaaactaaccaaaataaactgaatctaacaaccaaaggaatcataatgaaaacttacaagaatcacaaccacacagagaaacatatacccaaacataaagacacattttaataagttataatgtacaaaaaattacaagtattgtttaaaatatagtacattatgaatcaaaaataataaaacaaaagtattgttaattcacatcagttgtctgtctactacatggaatgaggattctgcatcatcatgtggattctatactcagtaaggtactactggggtaaactagcttttctatttggaaaattcattaaatggagatatctccttgaggttgggatgtcatatattattcctgttctcagttcatgggtcccaaatagctttgaccagtacagacactgtgcttgtgtcattctctgtagaagttcatttgttcatcagccctagtatgtctggaaggtattgttgccttgctggcattccttccagcaccactggccttagtatcattctacaatgtcttctacatattttgctgatccatggagtagaaattcgtatggtaatttatgattggatgaaccaaggttttgctatgcacattgtccagttatgggtctctgtatatagccccatctactctaaatattgcttctatgatgaagatgcaaaatacactaaactatgggtataataatgtaatttgaaatacttttattgatacatatcataccttattgtggtagatcaaatagtatcgagctgggttgttttttaaatttccagtcaggtataatacagaatattttcaatatcaccaatactattcaggagatgaaggcccatgcttgtcttctctatgttcaacagaaatgtaagtgttatcatctgtaatagagccatcattgattggtatcaagcaatcaacatcttaggcaattgtctgagatgtgtgtggagtactgggtaactcaggatgatttatttctgctttctttaactatgagttctattattttcttaacagctaagtaatatttcattgtgcagtgtaccacattttcatggatagctaggctgtctcctctttctttctcatatgaagaaactttcaatgaataggaatgagtaagtgtctatattaggctatagactccttttatatatatatatatatatatgccccaaaaatggtatacctggatcttgaggtacaacattcccggggtcccaatgcaaaatcacactggtttacaaaagggatgaactgctttgcatttccaaaagtagtggataaggattcttattgctcaccatcttccctagcatgtggggtcatttgatttattgatcttggccataatgattagttgaagattaaatctcatgtggtttgaatatgcatattcctgattactaagagttttgaacttttcttttactgaaacaaatatttgaatagtcaattaagggtcattagaggaagggatttatatgtgaaaacaaaagggataagtaggggaaagacattgtgtatgtgtgtgtgtgtgtgtgtgtgtgtgtgtgtgtgtgtgcagttttgttctttaactatcataagacaggccaaccacctgatgaatacaattttgttaatttaagaaacatctagttcataagtcagggataaaaaactatgaagctctaagaaacatgggcagatttttgatggggaaaaataaatgtggtcaggaaatcaaagagtctaccgaaaagtaaattgcaattaaacatgttcacatgcattctcagggcaaaaaacatttttagttccctatatctcagacagatttcattcttagccctaaatcacaagccaagtgatgcctgaaggagtgattacctctgtgctcacagggccatgtagcttttgacaaaacaggaagattgatggaaaccctacaaaaagttcttagtagaatgcagaggtatatgaaacaactgtgtcattttaaaagtatgtaaacagtcatctcaaagccaaatactatccctggtttctacataggcccttgaaggtatgttctccttcagagaaataggaagaataatatagatacctgttagctgtcacatcacattatataaaattaacacaatagttaaagacctcagcgcagtagctggatataaaattacctcaaacaagtcagaggtttttctctacaaaaaaggataaacaggatgagaaagaaattagggaaacaacacccttctcaatagtcacaaataatataaaataccttggtgtgactctaactaaggaattgaaagatctgtattaaaagaacttcaagtctctgaaaaaagaaattgaagaagatctcagaagatggaaagatctcccatgctcatggatgggcaggattaatataaatcagataggggactaatatccaatatatataaagaactaaagaaggtggactccagaaaatcaaataaccccaagaaaaaatggggctcagagctgaacaaacaattctcacctgaggaataccaaatggctgagaagcacctgaacatccttaatcatcagggaaatgcaaatcaaaacaaccctgagattccacctcacaccagtcagaatggctaagatcaaaaattcaggtgacagcagatgctgacaaggatgtggagaaagaggaacactcctccattgttggtgggattgcaagcttgtacagccactctggaaatcagtctggcggttcctcagaaaattggacatagtactaccggaggatccagcaatacctctcctgggcgtatacccagaagatgttccaactggtaataaggacacatgctccactatgttcatagcagccttgtttataatagccagaagctggaaagaacccagatgcccctcaacagaggaatggatacagaaaatatggtacatttacacaatggagtactactcagctattaaaaacaatgaatttgtgaaattcttaggcaaacagatgtatctgcaggatatcatcctgagtgaggtaaccgagtcacaaaagaagtcacttgatatgcactcactgataaatggatattagcccagaaagctagaataccatgatacaacttccaaaacacaagaaaatcaagaaggaagaccaaagcgtgggtacttcattcctccctagaatagggaataaaatatccatggaaggagttgcagagacaaagtttggagctaagatgaaaggatggaccatccagagactgccccacccaggggttcatcccataatcagccaccaaaccctgacactattgcatacacgccagcaagattttattcaaaggagcctgatatagctgtctcttgtgaggctatgctggggcctagcaaacacagaagtggatgctcacagtcagctattggatggatcacaggacccccaatggaggagctataaaaagtacccaagagttaaaggggtctgcaacagtgtagcaatatgaactaatcagtacccccagagctcgtgtctctagctgcatatgtagcagaagatggcctagtaggccatcattgggaatcttgtgaagctgcctgacttaaaaaatggatggagaggcatattcgccatgagcacacacagcatgcagatttaaaagagaacctgattaattagaccattgtgtatataatatttatacttccttctttaatgtgcattttcttccacatacttttcatttccgttacactacaatttatataacaaaaaggactttattagtcaacgtgttgaagctggttgctctttaaaatttcccttcactgtgagagttgccacattcacttttctcagccacggtggaggaggcagcacttctagcaacagtaattgcagatacctcccacgtggtggttattaccactctggattggctcaggaatttttcattatggttatacaactaactctgtacagggatgctgtgggtattagaggtccttctgaatgatcagtagcagttgtgtcagcaggtggatcctgttagcttctgaatgcaagcatgaaagcaggcccatctcaccctagtttcttttttttttttttttttttttttaacaggaggacaaatcttttcctccttaaattaaacactctaacatatatagcttttggcacctacatacctccacacatatgcacacatacacacacatacacacacacacacacacagagagagagagagagagagagagagagagagagacaaagacagacagaaacagagacagagagacagagaaagagaagaaagaccaacagaaactgagtgatagagacaaagattgagacagagagaaatatgcacacatgactaaaaataataaaatcaagataaaagtggtggcacgtgacatttttttcaagcacttataaggcagaagctggttaatctctgagttcaaagccagcccagtctacaaaagtgaatgcaaactctatcaagtaaaaccctgagaaaaaaacaaacaaacaaacgaatatataagtattcatggcaacaattttttaaaacatgaggcaaaaattcatcactgaatgacaaaccaatgctttcataaaacaacaaataatatgttcatggtaagagttccatttacatgaacacataggaaattttaaagatacgcctaatcaaataaacctgattaatgcagaacgttgttaaggtagcagcttttattgcttagtgatttctcctgacagaactacaagtatctaccacttttggactttccttaggttgtttagattttttttctaaccactctttctttcctttgtatagaaatcaaaaggtgaatataattcaatgttatgtagtcatcattgcccacaaaacagcttgaatttattcctgaccattttatacaggggtttatgacaaccccccccccccccccgttttcatactagcaatggtacagatcatagctcatggctgcctgctttttcattagctttagaaaagattttaaatccctgcagcctggcaaacatgcacgcatgcgtgattggagggctgtgcaggctcactagcacaaaatgggggttgggagtgtgattagtcaattcagtgcagcaggtcctgctgagccaaagatgcctgtcacatccaccctaggaatggtcagcaaggcaatgcagcaaccaaggtcagctcccattttgaccccttgtttctttaatagatatatatgatttgtgcacattaagtagtgcaagcttgatgggattagaacattatcctatatatttaaagtctttgaagaatcagtttagaaaattaccaggttaggacctggcttcctttgtcctgtcctgtgttgtattggctgcagtgcccctccctttgagccttcaatgtgctctgtcaattttgctcagttctcttacagggtgaacattaatatttcaaagaacagacagtattgtggattaaaggtgtgtggaaattaaaggcagacagaaaaaaagaacatttattttggtatatgggtgttgcacaataataatattcctaaaggaattaaaattatattgtgccttgctgtgaatataattaatgatgggaagggataaaagcacttgagagttaacatgcagatttttttcagagggaaatcacaacagataatggtgatttgcacctcccagtttctaaagggataggaggaacaggtaaatacgtgttttgacactttgatacttataatacaggaaaggggattccaatgtggcattaagaaagtaagtgtacagagtaaattcaggtgtgtgaatagtcaatgtgtggaaacatgaggtatctttacaaacagagatatagcatacatagtggtacagaattataaacctttgttctgtcatcttgtaatgtgatctattttaaatattgttatactgcttctgtgttgttaggtatttttatttattaattttttttaatctacagattcacaaaaagctggtgaatttggaagtaatttctttgaacacttaatctattctgtcctctattctcttcatgttgatgaagcttataagatatgcaaaggagcatgcacaaataatttgtggggtgactttctcaaagagataaattcacatgagtgagccttgtctttgttttttgtgtttggttgtttataggtcttactggaattctcctttaattttaatacaatatatcatgattacagtttcccttttttttctactcctcccagttcttcctcatctatcctcccttccagcttagctctctttctgtctcatacaaaaaaaaatcccatccaaaagaaaaccgccaaacctataaaaatgaaatatagtaagatcaaacaccatcatattaagggcgggcaaggcaacccaacagaaggtaaagtgccacaggagcaggcacaagactcagagacccacttgttaacacactcaggaatgccataaaaacactaggctgaatgttgcaacatatgttcataggatccactgcagactactgtaggctctggaacagagaggtccacagaggaatgtcctttgctttttgtcattttatttaggttttcatttcaaaatgttgggatttcttttacactctatattttatcccacctatccacccttcaactgttccacatccaatacctcctccccaccccctctctccacatggatgtcctcaccgcaacccacttgacctataaattcactgggacctccagtctcttgagggttaggtgcatcatctctgaatgaatacagaccctgacgtcctctactgtatgtgtgttagggggtcttatatcagctggtgtatgctgtctgtttggtggtctgtcgcttctgtctccgaccagcagaaaagagtgacaacacagcattcttctcaaagcagtttattcaggaaccgttcaacaggcaagcaggaatctctcctagcccccaatcacaatcccttatataacccctcaaccacaccccaatagcccagtccatgtaatctcagttcattggccttcatcaaatggcctgatcttgtgtcatggtgtgcctgcgcagctctcacgatggacatggcttatttttgggtgtatgaggaagtcaggtgcaagtcataagacttggctgcagtcctgggcgccatcttgggattaccgccacacccgctccccacactggtccagtgtttgagaaaccttggaggtccagataatttagactgctggtccttctataggattatctttctcctcagcttttttcagttcagccttctctaattcaacaacaggggtcagctgcttctgtccattggttaggtggaaatatctgcatctaactcttctagctgcttgttgagtctttcagaaagcagttatgataggtaccattttgtgggtgctccatagcctcaataatagtgtcaggccttgagaccttcccttgagctggatcccactttgggcctgtgtctggaccttcttttcctcaggctcctctccatttccatccctgtaattctttcagacagtaacaattatgagtcagatatgtgactgtgagatggcaaccccatctgtcacttgatgtccagtcttcctgctggaggtgggttctataagttccctctcctactattgggcatttcatctaaaatccctccctttgtgtcctaagagactcttagagttcagttctctggtgcattctggaggatccttccaactcctatttcctaaggttgcttgtttccattctttatgctggctttcagggcttcagtcctttttctttacccaatatcagatcaggtttccctctcccccacccctctttccttccttgtccactttccctcccaggtccctccttccctccccacttgtgattgctttcttttctctcccaagtgggactgaggcctcttcacttgggcacttcagcttgttgacctagaactcagagttctgtggacttatcttgagttttcagtactttttttggctgtatccacttattggtgagtacataccatgcacattcttttgggtctgagttacctcactcaggatgatattttctggttccatccatttgtctgcaaaactcaggatatcttcgttcttaatagatgagtagagttccattgtgtaaatgaaccatcttttctgtatctattcttctgccatgggacatctaggttgtttccagcttctggctatcacaagtaacagagctatgaacatagtgtttccaaagtagaatcacgtgataacccatgccgccagtattctgagggtttcttaaagttcttgcttctcaaatgttgctaattaatgaagttatagcataatagtaccataccatacaccttttttttactttaactgtgtagtataaatttaaatctgatatagtgctacctcttggaaattcttttattatttaaggtgggggttttttgttggttttttttttttttgtattgagtctttttgtttccatatacagttaaataattataagctgaatttgggtgaagtatattgttgactcttacattgaatatgttaaaattacacatggtttctgggattctttgacttaaaattcccagtgaactgatcattttatatgtcactaagattttctttaataataaatagcttcttggagtattattttcacaaaattagatatttctctttgcactaccataaatacatatgtgtatacataaaataaatgcttatatagaaaataataaatactccatatccattacttatggataaatgtatatgtacaacatgtaacttttattataataacacacaatatactctattttataactcataataaactacatacattactagtaaatctagacttttttggagtatggagtttttttccataagtatatgtacacatacacatatatttatacatatatatattcaactttacatataatatataaagtatactctatatatttgatatctatatataaaatatatatatatattcagctttacatacatttatatacacagtatatacatatatttatataaatgtcattacattatgatcatggatagctaattttttgtgttttatatttatatattagtttattatatattgtaatgggtattgtattacatgttttaaatataaaaaataagttctatgtacttatgtatataaataaatatatagctctgataaaatacttatgtacttcatatataatataaatacacacacatatgtatatatatgtatatatgtttcataaagattcttcatacaactgtatttttgctaaacataatccacttatttcacccaacataaagaactatccctattcctgattaaacatttagcttccagtactctttctataatactttatgttacatatgctctaatattcttacttaatattgtattaaatagtatatgctaacataaaagtttccaagtaacttctatatgtacatttcactttggctaaaccttgatgttgactctgacttttccaaactcaatcataccactatcaacataaaacttctgcctccagaaatcccctttctactttcatttactaagtattatactcccactcctctataaacacattcctcaatgactagtttccaatatcatatttttcacatggcctccgtaaaaccacacaaaacaacagatcttacatagccgcctcatgtgtcgagaacagggagcatttgttttctttcagattttattgatcactcactgctactggttcttctcattgccacctgtctacctgcaaatttcacttttttactattgaacattatttaactgtatatgtgcactgcatatatgttttaaaataaatatatggaaagcatgatgttattaattattcacatgtgcgtgtgtatgtttcattattctgtctgaagttatccagattgatcagaaccatttagtaaaaaaaaaaaaaataaaaatgttgttcaacaaaccggtaattgtatcagtgtgggattatatgtgagtcattatttcacttcagttaatcaatgtagtaagttttatgccatattgtgtagattttgtcacattagcaccatgtaaaatgtgggatcctgataattctttctgtttaattatttcggatttttttacatttattttggcttgggttttttgttgttgttgttggtgttgctgctgttgctgttgttgttaggttttagagttttttggtgttgttgttttgttttttatttaattttttttggaaaggtgaaacttcttattcccatatgaaattaaaattacatttttaattttgtatgaagatttttttggagattacactaaatgtgtgaattgcttttggaagaagggccgtttgtaaagtaatagctttgtcattttattaccatggaggcattttagtctgtaatttcttcttcaattaaattttctagttacttaaattgtcaatgtagccttttacattttagttgtgtgtgtgtttgtgttggaaatggcattacttctatgatttcttaaatactaccttagttgtatatgaaacctactgaattttgtgcactaaattttaatcctgtaatttgtgctgggtgtatcagttgcaacaggttactggttgaaaattaaggacaatttatagattgaaacacaccctattcaaattaagatatttgaacatctgactttccttgctgtatcatgtctttgtccttcactctttttcttgaactaagactcctaataatgtaataagtaggtggtgcagagtaaacatccttgtgtttttccaaagtattgtcattaatacttatctccatttactacgtttctggattttaccttgatatatattatctctcttaagtcaaaatgtgttctctgtatccttacaagtggacacatttctaaagaaaagtgaaacttgctcacccagcgcccatctatgataatgagcacccatgtgtatgactaaaccatacatgagtattcatttactgtacttggaggttttagtggtttttcatttatgtattgaccaacacagaatgcaacaagaatcatgtctaaccaaaccctgagaacagcacaaattgacggatatcatcagaaatctctttttttgtgtcagtgtctgaaaatgaccatttagaatagtatcaaatgattttatgctaggacctacaacttccctcctcatgtttttttttaactatgattacactgccatgcctgatttttcacccttagaagaaagtctcaaatgaaataaagaagcagttgcttagtccttagtgcagtttcactgctactgtatctttggtacactttacctctcatttcaatattgtagcctgcaatgtccagcagaagataaaaataatcattatcttttctcttgctagcaacgtaaatagcattttcttgtagtattaaagatagctaacagaaacaattatcaggttagtccaagcttgattttttttaaatatccagcaaatgaaatatgtgataccttcaacaatgtgttcttcatatttttatggggaatcaaaaataattgcactatcctgttatttgtagaatctttttgttttcaatgtccagtaactccaacctaagtaatttttgtctttcaatgaaatttgtatttaataacccatgtattcttgaccttcactgtctgattcatggcataaggtataaggctttgtcccagaatgtatccacaccaatctatgttatcttgatttcttataagtctaacatttggataacagatttgttactagtaatagtcaatccatgagtaaaagaaacattttttgttagaaaagaatatattccacctttaaattataaatcacataaatcactgaatgaagacaaggcattgactcaaggaaggaactggaggcaggaacttaagccgaagccatgctgctgcttaccagttttcaccatgtggctagctcagattgcttccttatgaacaccaggatcatctgaccaggtgtggtaacacacaaagtggactgggttctcccccatcaatcatcaattaagaaaattaccccacagattggtatataggcaaactggtagacacagttcaactgaggttctctaatcccagaaaactcaaattgagtcaagttgacaaaaaaaagcaaaataatatgcacatataatataccaaatacatatttttatatattacagaatatgtttacataattgatatacacttttggccagtggatcagatttcaaagacaaatacaaaacacaattcaatgaacagttgattttatatgcacctacaacttcctggtttttacctttctttacataaatatttataaatcttttgaaataccaaactcaaattactttttaatgcacttttaaaataaagaagaaagataataaaatgtattcaaattctccatctgttgagcatttctttataacttttccattaattaaatatagattatagtcttaccatattgtgtgtaagtatgacttgtatgcaagtgtaggtatatacatgcctcagtgtacctgtgaagttgagaagataacttttgagtgctggttcagtttcttctatatggcttccagatatcaaatttaggtgtctaagcttgcatggcaagtgcttttagatgtccagaaatttcactggcctctttccattaacagtttcacactaattaattaaatgcatatagtgaagtaccacatcattctcataatatatgtgtgttttatggcttattttcaggacagtttccaacaactggaaattggagtcagttccttaaaacattatgatgcagattgtcaatatattctaatttaaacttttttaaactaatttcacttactaaaatttttattagatatattttactttcaaaggcccacaggctgttacatacggacacagggtcctgcaagaactatgaacatacaagtaaatattctaaatgtttttattttaataatatcaagaaatacgacttaccatattataccaggatataaaattgtgacttgaaacaaagcatgtattgtgaagtctgctataactcttacatggaagaaaagcatgatttacattgccaaacccctgaaatagtggaaagaaattgcactgcggatagggaattgtgctgtcacaaggatcaatgtggaagagtctggtttctccagtggtttgtggaagaacttgaatgatctctgtctttaagacatgtcttttggtttccttcaaaatacatctatgttttattattatatagcaccaaaaatggtatgatttgacttattggattgacttgtactgggaaatcaagtagccctcgatttttcatctctgggttacatggcatgacatggttatatattctcactcaattacataccaattgctgacccctctcctggtctgaccttcacacaggacttccctccatacctagatcccttatcatttgagagagtggattctcccctgggtatcctcctaccatgccaccgcaagtctgtgaaaagctaagggcatcctcttactgaggacaataagaagccaggcaaaggaatggattccacaaacaggcaatagatttagtgtcagcctccactccattgttgtggaatctagatgaagactgagctccacatatgctacatataagcaggggtggggggctaagtccatcacacgaatgctttttcattggtggttcagtctctgagagaccccagtatccaggtttgttgattctgttcatatttctgtggatttactatctcctttttggacttcaatccttttctcaattcattcaaaagatatcctatatgccaaataatgtttgtctgtgggtctctgtatttgtttcggtctcgtgctgtgtagagcctctcagaggatcctaggtttctatctggaagcataacagagtataattaatagtgtcaaaggattagtgcttacccctgggatttgtctcaagttgctcaggatcttgtttggccattccctagatatctgctccatcttcatccctgcattttttgtagatgggacatattttgggtagaaagatttcattgttgattgaactccttatccctccacttacattcttgcctagacattggttttagccccttcaggctcatcttctcgcaagagagacatttaaatgataacatactcttatcttatctcttctgtaatttaactatctactggcctgggttttcatgtgccctgtgggtatccaggctccctagttcaccaagctggaatgcaaagaatgaatcataactgggccaggtagttttgagaggaacttggtcggcatgagtgttggataaattgccttctccagagatgtttttttttttttttttttttttttttttttttttttttttaccaaaacagcacttgtttactggggataagaagaattatataaaccttgaggcagagatagagcttttggggagggggtgagtatacaccattaactgtggctgaagtgctaggaatgcttcatttgcagaaagaagggttccaggtgcttctacatcctcacactgagagaagtttgaccagtaatttggtcaacagactaagtgactacctcaagggtgatggaggtggggacataagaactatgtgcactgggacatgcaggcccagagcaaggatgagattttcagggtttggacaggtcttgaactcattcttcctccagactggctccccccaggtaattcctttctggctccaaaactatgctctaacatctctatactgaaatagatcaagacaaaataatggttcacataaaattattacttacaaacaccagttacaaaaatattgctacttaagaccaatctttggtaaatttggaaataaaataaactacccaaatgaaaaatatgaaatctaaaacaaggataaattattttgcatgacctacacttataatattttctaaaatatgaagacctgtgtatacaatagaaataacaaggtcaatgttgataaggtatgtgatagcacaaggaatctgtgagtagatagaatgtttgcttttctaaattgctattgttacttctgttattcatactatggtaattattgttacaccttcatatacaataatcctgttctacagtgcatataaatataatgtcaagtacagcagaagagagtggtaatcacacctggatcatgagagtaattaatattaatatgatcccgaattttttttacttaatgcctttaccaatgttttgtatacccttaattctgtctcatattatctatcaccttttaagaaactttctgtgatggtttgtatgtgctctatgctcagcacagtaatgtcaatattagaaggtgtggacctgtaggagtagatgtgtcaccgtgggtctgggctttaagacactcagcctagaatagtattccacggtgtaaatgaaccacattttctgtatccattattctgttgtaggacatctgggttgcttccagcttctggctatctcaaacaagaccagtatgaatatagtggaacatgtgcccctgtggcatggtagatcatcttttggtatatgtccaagagtagtacagctgggttttcaggtacacctatttcacattttctgaggaacctcctgattgatttccagagtggttttaccagtttgcactcttgccagcaatggaggagtattcctctttctccacatccttgccaacttttgctttcacctgagttttttttatcttagctattctgattggtttaaggtagactctcaggtttgttttgatttgcatttctctgatcattaaggactttgaacagttctttttctgtttctcagccatttgagattactttgttgtgatttttctgtttagttctataccccattttttgattgggttgtttggtttcttggtggttagcttctcgagtatatatatatatatatatatatatcctgtatcagatgtagatttagtgaagtttttttcccaatctataggttgccaatttttcctattgactatgtcctttgcttacaaatcctttccagttccatgatgtcccatttattaattcttgatcttcaagcttgtctgagccattggacttctgtttaggaattttccccctgtgtgtgagtttgaggctgtttcccacattctcttctattaggttcagtgtacttgtttttagtggatgttagcttaaaaagtacagagtatccaggatacaattgacagaacccaggaaatgtaacaagccaaagggcccaaatgaggatgtctcagtcccacatgagagagagaaggaagcaattacaggggaaaggagggtgggagggacacagaggggaagggagaaacattatcaggtacttgtgtggggggacaggactgaagccttgtgggccagcagaaataatggaagcagacaacctcaggaggtagaagtgagggaaccctctaaaatgtaacaaagacctagaaggtgagagactctcaggaatcaaactgaaagacattaaatgaaatgccctaccgtggggagaggtaatgtgtagagcccacctccaatagaaacacggggtatcagttggagggatggggtttccatcccactgtcaaaactctgaccaagaattgttctttactgaaagaacttcagggacaaaaccaaagaggagcatgaggaaaaggaggtccagtgacagccccaagttgaggggaggccccaatgcctgacactatttctgatactatggtgtgtttataaataggagtctatcttgactgccctctgacacccaaccaatggacagaagatgttagcccccgtggttgaagtagggaaaagctacaagaagctgaggaggggtacaaccctatagaaaaaccagactaaaatggatgcccaagatctctcatacactgagtcacaaaccaggcagcataaccagctcatatgaaacctttaacacctatacagcagaggactgcctggtctgaactcagtgagagaagacacatctaacccacagtgacatgaggccccagggagtgaggaggtctggtagggtggggaaatcctcttggagacaagggagaggaggacttatgggatgagggctgactgggagggggataaaaactgaactgttaaaaaaaaaaagacttgtattggtcatggtgtctgtttaccggagcataaccccatcaaagataaaatttggtaccaaggactggagtatctttgtgatagaactaaccatgcttttgattggagtaatgtggatttctgggagtttggaaagcagtgaaatgctttaagttgggattaatgacttattctagtaggaatatggaaaactttgttgctgaatatgattgaactataccgacatagcccaaaaggtttcagtggagtagaattcagtatgtggcctagagactgtttttgtggtattttggctcctttttgcctttgtttgtatagtctccctgaggctgaggtaatgagatttatattaattgcattgacaaaggaagtctcaaaaaagcccagcagagactttgatctctgattaagtctcatgaagagcattttgaataagcatagtgatcttagaaagaaacaatataaaatatatggttcaagcattaaaggggctccaggaagtgagatggaactgaaacctatgtgctaggagaaaacagattaagggttttggggcaagatcctacccagctatgtttagatacaagtatggtgatataaacctttaatctcagaatacaaagccaagcagatctctaaattcaaggacagcctgggactgagcaagttctaggtgaaggaaagtttaaatccaggtgttttaagacccttaatcccatgagcagagcatgcagatctcttagttcaaagtcagtctacaggggaatttccagaacagctaagtttaggcagtgaatgagctggaaaacagaaagctggtgaaaacgtaatataacaagggaccaagttccagctgcagtgagcagcagaactcaacagatttgatcatttggctctatttttatagtcaagaggatgagactgttgggacaattgatgctggttagctggagctaagagcttagcatggttaagaggagaccagtatcactgagggaaaatcttctgaaaagtgttttctgagaggacaacgaagctgtgttctagagataggcaaggttgtacctcatgttgcagctgtacttggtaatgtgtaagactcacccaggtggtactagttttgaaggcatgaagtggtcatgaagaacagctgatgcttggcactggagggggccatggaaaaccactggtgaaggtgcatcctcagttctatgtgacagcccaggaatgaagtggtctggcaaatgttttgatccttgacaccatgaagagaacctatgagaggttattggtgaagcctaattgtattggaaatacccagcatattggagatgccagtaccatggactgatcaccaagaagagcagctgcaatggagtggatcaacctgagcttagagagctacagagggcagagctggagaagtgatgctagccctttggaggagcacagaggatcacgggtagatcctagacattgaagcaagaagctgtaacattgccattgccttggggaacacaagatgttggagatgccagagccatgagctatctgttattgaaggcagcacagaagaaagaagtttgttgcattcaacaaagattaaaaaaaaaaaaaaagacttggagatcggaaacccactttgacatcagacaaggacatacatactttgcagtttttccagctggtttcctgtcttgctttggaattacagttaagtaattaattaaatctgagaatagtccttggacttttaacattgttgagagtgctatagactatggggactttggaaattggactaaatatattttgcattatgttatgtttaggtatggcctccatagattcatatgtttggacaagcctaagggggccagggaataaaatgttatggtttgtatatgatcagctcagggagcggcaatattaaacttgtggccctgttggagtaagtgtgtcactgtgggtatgggctttaagaccctcatcctagcttcctggaaggcagtattttgctagcagcctacagatgagggcatagatctgtcagttctgcctgataccagtgaatcaaggatttgaatggtaaactatgtgtcattagaggaagggatttatagttgaatataaaattgctatgtagtagaaagccatgggaaatagaggtaaagaacacaatgtaaggtttagtattcagagagaaaacagcaagtaaggcacctaagcctttgagatatacttcagaggagttaagcaagtgcattttgtgtgtgagtgtgcatgtgtgtgtgtgcacagtttttttctttaatcaccataagagaggccagccagtggataaatagaactctgttaatgaatttaagaaacatctaatttataagcctgggaaaagaaactatgaaactctaaacatcatgggcagattttggatatgaaattttttttaaaaatgggatagggaaattaagcagcctacatcaaagtaaattgccattaaaaaaaatgtattctcagggcagaaactccctttagccctcctaaatctcagacacagatttcattctttttgataaaatcacaagccaatgttcagtatcatgtagcttttgacaaaacaggaagatttatggaaaccctacaaaaagttcttagtagaacacagatgggtagggactatgaaataactgtgctgttttaaaggatttaaacagtcatctcaaagtcaaatcctaaccctagtttttacaggggccccctaatgtatgttttccctcaaagtcttaggaagaataatgcaggaccctgttagtgggaacatcacattatacacaaattaacacagtatttaaaaaaaaatcaatgagtatcctgtgattgattctctgactttaaaaaaggatggagagaaatagttgccatgagcacatacaacatgcaaatttaaaagagacattgatttattagaccattacatatgttatatttatacttcattctgtataggtgcaatttcttccacacaattttcatttcagccacactacaatttatgtaacaaagatggctttattagtcaaagtgtcgaagctggttgctctttaaaatattccttcactatgagatttgccacatttattttcttcaaccataatggagggggcagtacttctggcaacagtaatttcaattatcgccttcaatgatgctccttagcacttctgaattgacctaggaaatgtgctattttttcattagggctgagcaactagctctgtacatgggcgtggtaggcaatagggatacttctgaatgatcagaagcagttgtgtcagcaggtgaatcctgctagcttctggatgcaggtagtgctcagaagtcatcttgaagacaggcccatcccaccctgggtttcttttgctacttaaatctaacttttcctccttaaatcaaccagtctccttagaatgattgcttatcaaatttttcaacatgttgtaaagcccaaacaactttgttttttataaggcatctcattttgtgagagacgaggggctaagctccaactctaagaagaaaatcacaaaatccactgagcaaacatcttatggaaaccttaccaacagccagtcaggctaaaatagcagagtcaaggtacatattggaattctgtctggactccacccccaaagatacctggcaacatctaggtatgctcctccccacagttacctggaaacagccaggtaggcatgtcccactataaaatgagctgtttgacccctcctccctctcttacactcttggctctcttacctctctcttagatcccttcccccctctctccacaggaccatggctagtctctacttctctactctcttcttctctctgcctatatctgcctctactactctcttaactctccaccccatgccctaaataaactctattatatacttcctatacctactgtgactggtctcttagggggaagggatgccttagcatgaacccactgaggcacccccttcccccacatcccatcagaacacattcttatagctctttctctttttatgatcacagcattggtgcattgtgactcggatccagaaactctagaggtttgcatcccacctaggctaccacaagagatagttaacttggatatcctgttcatcagatggatttgtccccatgtttcagtcctgcagagtacaccagaaatagagttttttaaacgtcctaacccttataaaaagtccccaagtttgctgtaacaacaataaaaacactaaaaccctagattggggactctcactctgacatgctgtgacaggaactgtgggggaccgtgatctatagcttataatgaagaccattatgtatttatgtcagaattgcctctgatatggtcttttggggggtccctgtaatttgagcataacactaacccaccaatttaaaagttctatttaccttgtttcttgatgttgtactctggtttgtacctttctacaaacagctgataagacaagtgtttcctagaataaacataattctgttcccaaagtgtctttaccctattatatatgcttacacgaagcatggccttgagccaaattttttaattcttgtttttatcagtattagtggtattcaatttctattgtcttacatttaagattttttttccataatttttcttctttgtttattttctcattcattacatcaccatattttccacaaaccactccaggtaagtctcctcaatatctttcctctcatccagatccactccttccactccctttaaaaaaaacaaaaaacaaaaaaactggtttgagaaggatgtgtcaggaaaacatactaccttagcataaagagtttacatttagggtacgatgaaaacctctcagccatcctgggtaaagaaaccatcagcaatttaactgcttcaggatgaagtaattgaaagggtttattatgatggatggtatgtttctttgttaacaaatacttttaaatctcattttttagaattttctgatgagtggatttacaaccacgccaatttgcaaaagatgttttctacatagtaccgactagaataaacccacattcaagttgagaacatccttttccttttagtaccctcaacaataactaagatcttaatgcagcttcctgctctagtcaagagacatgctacaggaactaagtcataaaagcgctgcatggtgtggtgaccctccccaccaccaaaaaatagtaagtagaccatggatattaggatattgagttagtaacaccaatgaggtttgattttgctttgttcaaattgttgcttgattcttctctcttgaagtaagaaggtagtttaatttttttttaattttacaagagcacatttttcaaaatgagattttagagttttatagagaatttggattttaagaagcattgcattttttaacatactgaatttttaaagtgttcgttttggcaacaatgtgggtctttgtaagtcccaggacagatatgtttgatattcaacctgtggtaaattacttgtccaacataaatagatttgagtttgatcttcatcccaagtgaaggttaaattgtacacagaaggaactactgcatccaggagacagagcagtaaaaatataaatctcaaggccatcctaagcatttctcaggacagcctgagtccatttcagaggaaagttaatatatgctctgtgccattgtgttctggaaatatgtaacttgcttttgattttacatgtatttcattgaaataattgacttgaggctcagaagacacattgaatttttaaacaatgttcattctatgaaagataatggagtcttttaaagttgtacagtatacttttttatgatatgcttgtgaaagaaaaggtatagaatacggtggtttgaatgagatgccccctattagcatccaatttttaaacacttaattctaagttgatggctgtttggggaagattaggagatgcagcattgctggacaaaagatatccctgatgtttgaaacatcatgatgtttcaaagagttctctctgcttgccctctgtggtttgagatataagttgctaattcagcaaactgctacttgccactaaagatacagaagactggaaataatcttttgctactacaattttaattttatgaatatattgttgttgttactataggattccaaaacgctatcatggctgtagttaatcaatgtggactctgcttattcccctcaggtggtagattaaagggcatgtgctcttttttcacaaaaatatttaattgcaaaagttattaatgatcaaacctaaatgcacatttaagaattaaataaaaagcattcaagctctattgactcatgtctttattcatttcattctagagatagacccaaaaggattactagaaatttgaggtcagtctaatctagagaatgagacactatctcacaagttcaaaaaatacaaaaggatttgaacaaaaaaaaagaaattaagtaaaggataaaaggaaggaggaggaggaagagggggtgaatgagaggactccaataatcagagacaatgaaaaaatcaagaaaatggagtaaattgataatcacatgtaaactagaattctatgctatggaaagtaggggttttgcaaaaactgagaatataaagattaaacttctgtcaagaaaaataacaaaaacagtaagtacacaattctttatattcccagatagtgtacctcatgtcctttgggttaattttaagatctacaaattccacattgctacaactcttctaactgcctacattaagtatctattgaattgggcctgcatatttctcttccttacaaagatataataagcagtacacagaactttccataagtttccaaaataacaatatcaatgctagaattagaatcaaattatagattatgaaggcgtggttttaattcatagaacatgatagcttactgcacacatcttacaagtttttattcttagatataattgaggtaattattctctctttcaacttcatgtgacatagaatcacctgagatgcaagcctctgtcattcttgagcaggattaacttaattaattaattgagttaggatatcctgtccctttgggtaggaccaggttgaggatcctcagcactgtctgcttcactaacactttctgtgttccaggcaagaatgctacaacccaaagtttagagactgataattttacatgcacatccacaattacttattagttgtatgataaaaagtgcaatctatttaaaaacacagattttgctttaggtattttcagtgtcctaatctcactttgacacatagagtattgatagatgcagaaaaggttggattcattttcttgtttagctaaccctatatgatccttgagttatatatatatattatataaaatagaagacaggatagccatgatatgaaaacctttagccttaaccttctaggtggcagataaagatgggacactttttgtttaaaggcagtgtattctacacagcatgttcttggccagaaagagctattgatgcaaagatagttttccctttcccacatagactttgacgtgcagaaaatgatatcactaagtcaatattatatttacatttactggaaaagaattgaaagtatgaacatttaaaatcaggagccattctcctttttttgtttgtatttttatttgcatatgcagcagtcatctaaatcacagaggctttaaggtccatagaagagcctgagtgatgcttctgtgattaaaaaacagatactgttctgcaagaggatttcccagaagacatgtcaggattctaaaactacatgtaactgcagatctggagaaatattcagcctttggcatctacatagctctacacaaatgctgacacatgcacgcgcgcgcgtgcgtgcacacacacacacacacacacacacacacaggagggggttttgggggagagaacagacagagtctgagtgatagacagaggcagaggcagagatggagacacagaaagaaatatacacacgtgtttgcaattaataaaatctgggtaactgtggtggcacaagagtttacttgtagcccttatgagagcgaagcaggtaaatcattgagttcaaagtcagcccagtctacaaagtgacttaccagtccaggaatttctaacaagtaagagtctgtctaaaaaataaagaaatgaacaatcaagtaactatcttatagcaacaatatttggaaacacaagaaaaagatttcctcactgaatgaaaaaccaaggcttttagtaaacaacaaatattatgttcatggtaagtttttcatttacatgaacacataggaagttttaaaaatgtacctaatcaaataaatcccaattaatgcagaacgttgttaaggtagcatcttttattcctaagtgctatctcctgatagcactacaattatctagtgcttttgtactttacctcgttttggtaatgttttttataagcacactttttttcctttgtaaagagatctaaatggaacacaattcaatattatgtagtcaccattgcccacaaaacaccttgaatttatgtataaattgaaccaatgtatacaggagattatgatgacccacttctttcatactagcaataggataccataaagctcatggcagcatccttatgttattagctttacaaaagattttgaatccctgcatcctggcaaacatccacgcatgcgtgattggagggctgtgctagctcacaagaacagactgggggttgggagtgtgattattcaagtcagtgcagcaggtcctgctcagaaaagaggcaggcaaagatggctgtcacatccaccctaggaatggtcagcaaggcaatgcagcaaccaaggtcagctctctcataaccccatcatttctttcatagttagacatgttttctgcacattaagtatttcaaatttatgcatctcaaaactttgagtgatgaatcagatgagaaagctatcagatcaggacttgcattactttgtcttgtcctgtgttgtgttagctgcattgtccctccccttgagccttcaatctgccctgtcacttcagctcagttctcttacagggtgaacatttcaaagaatcaacagtattgtgaattattggtgtgtgggacaaagggcagacagaaaagaaaggatatttattttggtatatggatgtttcataaaaataaaattcctaaggaagtttaaatattcttcttgccatgaaggatgggaaaagataaaagcacttaagcattaacatacagcttatcggcagaggaaagactcaaaagactatggtggtttgtgcttctcaatttctggatggataggagaattaggaaggtatgaattttgatactatgatgcttattataaagaaagggggattccaaagtagcattaagaaagatagtggacagggtgaattcaggtgtgtggactgccaacatgtggaaatgtagggtatctttagatacagagctgtagcatacacactggtagaattataaaccttttttcggtcatttttaatgtgcattttgatattgctatactgcttcagtgtcattaggtacttgttatttattatttttgaaatctggcccagattaaaaaagaaactggtgacttgggaaatatttcttttgaaaatttaatctattcctctgtgttctgaccaccttattttgatatttataaggtatggaaagtagcatgcagaatttttttgaccattctctgatataaatccacaagagtgtgccttgctttttatttttttgtttgtttgtttgtttaaaggccttattggaattatattttgtttttcatttcaaaatggttttggatgtaagttttattggaaaataattttaatacaatatatcataactacagtttccctttttttctactcctcctagatcatccccaacctaccctcccttctagattagctctctttttatctttgactagaaatgcatgcccaagatacaatgaccaaacaaatcaaaatgaaatataataagatcaaagacatattgagagtgaacaaggcaactcaacaaaattaaaagtgcaacaggagcaggcacaagaatcagagatccacttggtaacacactcaggaatcccataaaaacactaaagtgaatattgtaacatgtttatagaagacacagttcagactgttggaggctctggaagggagaggtccacagagacatgtcctttgctttttgtcattatattttgtatttcatttcaaaatgtttggattttaggattgctaaggtatttccaaagtagaatcatgtggtgactcatgccaccaactcactatttgtgaaggttattgcttctcaagtggtgttcatcaatgcatagcaatgccatatcatacaacttttgttactttaactatgcagcataaatgtaaatctggtatgatgatacctcttcgaactcttttattatttaagtttttatctacactgaagtttttttgtttccatataaagtcacatttataagattaatttggatgaagtatatcgttgatttttacattgaatatgtataattatatatggtttctgggattctctaatttatataccttagtgaattaatctttgtctgtcactaagattttctttgataactcatatctgcttggagtagtattttcactaaattaggtatttctgtttgaactaccataaatatatacatacaaatatataaatatatgtaaatgcttatattatatataaaaatacatcataaatatactacttatatatatatgtatatgaataacatgtaaattttattattatactatgcaataaagtatatattatattacataataaagtatacacataactattaaatttggactagttgtacttgattcaaatatggagatatgtatgtaatatgagtgagcatacatatatacatatgtacatatgtgtacaaatatatgtatatatatttgtatatgtatatatactactttatgtaatatatgaaaaatactttatatatattatatataaaaagtatatatactcatataaatatcttcaaattccaatcaagtgtagctattttttatattatgtagttatatatgtagtttatcttgtattacaatacatatattacatattataatttgaaatttttatgttacatatatattaataaatatataagtatgataaagtacctgtaactcatataatatgtgtgtgtgtgtgtgtgtgtgtgtgtgtgtatgtgtgtgtttcataaagattcttcatacatcttacttaacatattccacttatttcacacaacttcaggacctatcttgattctcgattaaacatttagcttccagtactcttcctatatgattttatatcacatatactctagtatttttactattgtgttaaatagtataagctagtgtataagttcccaaataacttatatatgtacatttcggttaaaccatgctataaaccactatttttccaaaccctatcataccattatccacataaaacttctgcctccagaaatcccctttctactatcatttgctaagtattatactgctgctcctctctaaatgcattcctttatgccattgactagttttaaatatcatatttttcacatggcctctataaaacctgacaaagcaaaagaccttatgtggaagcctcatagggagtgaacagaaagaaattgtctttttaaagtttgaatgctatcactctctgttactggttcttttcatttccatctatctacctgcaaatttcattcctttatacttgaacatgagttaactgcatatgggtataacacacatatttttaaaatagatatatgaaaagcattatcattttaattactcatgtgtgtgagtatgtgtgtgtatcgcacacacatgtaccaaaacacatgtaccaacagtacctatgcaaagtcagatgaaaaaccttcataagtctcttttcttctaatgtttgtttttgagctatacacattttctcaggaacatttaaggaaaaagaggagggaagggggagagaggaagagacagagacagagagagagagagagagagagagagagagatcttattttcatgtacaaattatacatatatgttggaaccatgtgaacagatctgtgtgtaacaaattgccatctagggaacagagtaaacatttatagtttctgaaacatttatagtatcttgatgttgatgaaattcaatgtgctccccaggtgatcaatggtataggatgctgaaagatcatatctttaaatacaatcactaagtagagagaaaaaaaaagagtgagcacaagacttttaatcttagaacccactggatgtgatatatttccatcagcaaggctacaccttggaaaccacaccaaacagatccacaacctaggaaccaagtgttcaaatactagaatctgtgaggaacatttcttattcaatctatcagaactactccctgtcctgtaatgcctgccaatccagttcgaccactctcgtattctccagaaaaatctcatggcccttgtcattccattaatgaaactaaatgttgaaaaggtagaggactgtgcaagtaacatctgcccacagcttaacttggtgcaggaaataaatgaacaccgcaccttatgggatagataattgcctacccataggagaaataaaacttttaaaaacaattttttcagcaagtaatgttctcattgtgtagccctgactaatctgtactgagtatgtagacctggctagtccttactcacagggattttcctcagtcttccacatcctgggttcaaagacatatcccaccattcttcagcattatcttcagcattatttggcatgcatgtcttctaaaaactgctacagatgcttaaaaatcttccactaagttggtaatacagactgtgaactttttataacatttctcacaggtattcatggtggataccatgcatggttagaagcagtgggtgagtttcctgaatatagtccatggttttgctcaaattcaatggctatagcttagaaagggaaaggcccaaaggattgtctctggattgctattcattgctgctgtaccttttcatgtttatcattgttgtattcttcatatatctaaccagctgtgattggactggggagactctcactgcctataatctgctgtgattccctcttggaagataacccactgcattggacaatattcctgtagatcaatgttaaggtaaactttcataaaatattgtatagatgaattcttgattttaaataattaatgatttgactcaaatagacttaagacattatagtattttgtagaaagattaagaaggttgttaagttgttatgttgacagaatgatgtaataaagttagaattgagagcagattgtgtttcatcccttgtagaatagttaggactacataggttaaaaaagaagtacagtgactttcatttcttgaaagcatgacatgtacttggttgaaaataatagccttggttctagttagtgattaaatagagaaaaggaaaaaaaaaacatattcttgcagtttggttctgaatttctggatccttttatcaatggaggtagccacaggatttggtatgcactatgaaagacggggttatgaataaagaggaaatagttgtattaaaagcacagagaatagatgattattcaatgtgcctgaataagtcatgtgatacatgatgatttgtttctgggtgaatacaaattttcatcatctgggcataggacaaaacttgctacaacaaactggcttgtttaaactttaataatcaatgagaaaagaaatattttcttctataattttgttgaagatatttgctggccctttaagttgaaaatcttcattctcatctactcctattatctgtacgtttggttttctcattgtgtcctggatttcctggatgttttgagttaggatctttctgcattttccattttctttgattgttgtaccgaagttctctatggaatcttctccacctgagattctctcttccatctcttgtattctgttgctgatgcttgcatctatggttccagatttcttccctaggttttttatctccagcattgcctcactttgggttttctttattgtgtctacttccctttttaggtcttggatggttttattcaattccatcacctgtttggtcgtgttttcttgcaatattttaagggatttttgtgcttcctctttaaggtcttctacctgtttagctgtgttctcctgtatttctttaagtgagttattaaagtccttcttgatgtcctctaccatcatcatgagataggcttttgaaaacgggtctagtttttcggatttaaatttgttgttcaatgccaaatgttcagcactaaaaatatatacaagtaacactattcagacaaaacaggttatatacagaaaaatacatgggtataaatatatttatatataaatatatgcatccagtaatttggatatggagaaaagacatcattaatttagtgaagagactggatggtgatgtagaaatacttggagaaatggaatgaaaaatctattttcataaactaaaaagtattaaaaacttaattttatataaaatatatcactatttaagcccatgaaagatgggtcaaattgagaaggggcgtgctgccaagtcaaaaaacaaaaaaatgaatttaacctctgtgatccaggaggtggagagaaatgcctaccttaactggtactgagactttcacacatggacatttaatttgtgtgggcatgcatgtgtgtgtggttgtgtatgcatatatgataatgcactgacattaaataaataaatggtattctttaataataatttgatctttgacaaattctgggggctgtgcattcattattcatgatgtcatctccgaatattgatttaaaaattattttgattttagatggttggtttgggtttcaaaacagggtttatctgtatagacctggctatccaggatcttgcttcatagatcactctttctcaaacttaataaggaagtgaaagatctgtatgataagaacttcaagtctgtgaaaaaagaaattaaagaagacctcagaagatggagaaagacctcccaggctcatggattggcagaatcaatatagtaaaaatggctatcttgccaaaaggaatctacagattcaaggcaatccccatcaaaattccaactcaattcttcaacgaattagcaagggcaatctgcaaattcatctggattaagaaaaagcctagaacagcaaaaactcttctcaaggataaaagaacctctggtggaatcaccatgcctgacctaaagtggtactacagagcaattgtgataaaaactgcatggtactggtatagtgacagacaagtagaccaatggaacagaattgaagacccagaaatgaacccacacacctatgatcacttgatctttgacaagggagctaaaaccatccagtggaaaaaagaaagcatgttcaacaaatggtgctggcacaactggcggttaacatgtagaagatgcgaattgatccattcctatctccttgtactaaggtcaaatataagtggatcaaggaactccacataaaaccagagacaatgaaacttatagagaagaaagtgggagaaagcctcgaagatatgggcacagggaaaaaaaaatcctgaatagaacagcattggcttgtgctgtaagattgagaatcaacaaatgggacctcataaaattgcaaagattctgtaaggcaaaagacaccgtcaataagacaaaagggccaccaacagattgggaaaggatctttacctattctaaatcagatagggaactaatatccaatatatataaagaactcaagagggtggactccaaataatcaaataacttcattataaaatggggtgcagaccttaacaaagaattctcacctgaggaataccgaatggctgagaagcacctgaaaaaatgttcaacatccttaatcatcagggaaatgcaaatcaaaacaaccctgagattcaacctcacaccagttagaatggctaagatcaaaaattcaggtgacagcagatgctggcgaggatgtggaaaaagaggaacactcctccattgttggtgggattgcaagcttgtacaaccactctgaaaatcagtctgcttgttcctcagaaaattggacatagtactaccggaggatccagcaacacctctcctgggtatatatccagaaggtgttccaaccggtaagaaggacacatgcttcattatgttcatagcagccttatttataatagccagaagctggaaagaacccagacgcccctcaacagaggatggatacagaaaatgtggtacatttacacaatggagttctactcagctattaaaaagaatgaatttatgaaattcctaggcaaatggatggacctagagggcatcatcctgagtgaggtaacccaatcacaaaagaactggcacaatatgtactcagtgataagtggatattagcccagaaacttagaatacccaagatagaagatacaattggctaaacgcatgaaactcaagaagaatgaagaccaaagtgtggacactttgccccttcttagaattgggaacaaaacacccatggaaggagtaacagagacaaagttttgagctgagacgaaaggatggaccagctagagactgccatatccggggatccatcccataatcagcttccaaacgctgccaccattgcatacactagcaggattttgctgaaaggacccagatatggctgtctcttgtgagactatgcaaacacagaagtcgatgctcacattcaggtattggatgctgataaagggccccacagggcccccaatggaggagctagagaaagtacccaaggagctgaagggatctgcaatactataggtggaactatatgaacttagcagtacccccggagctcgtgtctctagctgcatatgaatcagaagatggcctagtgggccatcagtgtaaagagaggcccattggtcgtacaaattttatatgcctcagtacagggaaatgccagggccaaaaagtgggagtgggtgggagagcatgtgggggacttttgggatagcattggaaatgtaaatgaaataaatacccaatttaaaaaaattagaaatggagaaattataaactctcattaaacatctttatgttgtggcagtgttatagctaggcacattttattttaggcaacactcttcagtaccaccagccatttgttttcaactccagtaactttaagataagatcctgataatcctaattcagtaagcctcactcaaaagtgtaaagtcatcactatctagttattatatgactaactgattttttttttgcttctataactttcttgtgcagatacccaaagatgctttggattaccttaatcactagacagaacagcatagttttttttttttttttattgctgttgttgttggttgattggttggttggttttttgttgttgttgttgttttgttttgttttttgtttctttgtaagtataggtataatatatatacatatacatatacatatatatatttgcatatatactaatatatattcatatatgtatgttttctctcagctcaagcaatcaataaatgaaagcataacaattcatcgttactactctccatcatgggtctccagagagagaaaacagtacttaaaatatttgtgcccacgtaatcaagtatacttaatatggtcagtttaaaacatgcctaagccgggtgtggtggcacatgcctttaatctgagcattcaggaggcaggggcaggcggatttctgagtttgagtccagcttggtctacagagtgagttccaggacagccagagctatacagagaaaccctgtctcggggaaaaaaaatgcctggatcttcattggtgctctgattaaagttaattctcaggaagtcctagatacatctaggtgaaaggataagtagggtagtaataatacattttgctagttctttttttttttttttttttttttttttgcttttttgtgtcttcagagcctacttcaacctggcctacttaacaataactcattgatctacatgcattcttaatgacctgaaggtaaagagtttgtagattcagttcaaaataagcttctcaagtcacatgaaaagttgattactgaaaattaagcatttaatctgcactaaatctcagtagttaccaaaagctcctttctatagaaagagaagttattctcaaagaactacagagacttgatccaaaatccttagaaccaaactacaaatcactaggatcctgaaaaataaatgcacccaatggcattgctacctgcccctgacagttcaataccaatggattttttgactgatatagatcgatgggaacaggatattccatggcaacatggcaacttattaagactgacagagacctttcttatgttctgtgttctactcaaaggccttctatataattaaaataattttggcattgaaacttgattctctgtttcaaatttttctttttccaattttgcccagtgaaactggaatctaccttatacttgttggaatcagtaaaatagtataatatacctgtttactaattttattggtcatggcttactagagtaacagaattcatgaattaaatatataatattttatatagtattttttagttttatttatgtattttatgtatataagcacaccattgttctcttcagacacaccagaagatggcatcagatcccattacagatggttgtgagccaccatgtggttgctgggacttgaactaaggacctctggaagagtagtcagtactcttaactgctgaaccatctctccagctctgtggtattatttagaaggatttacaggctgtagtccaactaacccaataatagctctctatgaatggaaaatccaataatccagtagttgttcagtctattaggttggatttctcagctggccttttgtatataattagatcatgaagaaccaggattttatgctaattagtaatggacttgctagtcaggcaaaagcaagtaggcaaaaaccaaatcatccttcgatgtccttatacaggcttcctgtaggagatgtgtcccatattagaggcagatttcccaattaaattatctgttttaaagttctatttcagattttgattgacacattacattttagcatattattaatattatattataggcttcctaattatattaggcttccttaattatattattaattaatattataggcttcctgtatgagatgtgtcccatattagaggcagatttcccaattaaattatctgttttaaagttgtattttcacacctaaaatatccacattaaaggtgtgtttcccacctcaaatatccatattatattatataacattatattatatgcttcctaattatattaggcttccttaattatattattaattaatattataggcttcctgtaggagatgtgtcccatattagagacagatttcccaattaaattatctgttttaaagttgtattttcacacctaaaatatccacattaaaggtgtgtttcccacctcaaatatccatattaaaagtggaccttctttcttaaaagtaagcaaaaattattgaaatgtgtccccaaattttggtttttagttaattccagatgtagtcaaggtgtcaacaaagaatagctatcacatacataaaatattttcagattttgattgacacattacattttagcatattattattgtctttgtctgaaagactgcatatattcctgtttatatttgcatgtgtatgtgtaggtatacacatacatgcacataatgactataagtcaatctctataattttcctcctatacataataattttatattaatttaattcgaaaggggaaaataccatgagtttgaaaatcagagaacaattttcaggagttaatattctcattgtactgtgtgacttttagagaacatgttgagtttttaagctttgttgcatccagctttactaccttcatctttatagttccatccctttaaactccaaaacaagaatatcttacctaattccacagagatattcagttcaaactctaagaattttaaaatagtttaaagtgagattttattttgttgatatcctctgtatttcagatacttttcatgcactctaaagcatgattagatgtttggggtaagagtctgttgttaagcctgtacaaatactgtgctgtccacccacaacagttgcatgtatgactagaggactgtggtgagtcactagcacagccagaatggatggagtatgatgagtcaagtcagttgcagtaggtcctgctcagcaaaaggagagagtttcatccacttgaagaatggtgggcaaggcagcgcagacaccaagcacagtccccaaagccatcactgtatcttccatagatgggcataatttttgtaggttaaggatcacagatgttcagaattagaaccttgttgcattgatctaaaatctttgactctaaagaaccagatcagaaagctatcagatcagaacctggactcagttgcccctccctccatcatgttatctgcacagtgacccttctcttgatctgtcaatcactcctggtactttagctcagttctcttcctgatttgcaattgctcaatggttgggagaatcagaaaattttagttctgatgttttgatatttataataaaaaaagggatttccaaagtggctgtaagaaaagaaagaggtgaacacagtggactgctctctctctctctctctctctctctctctctctctctctctctctctctctctctcttcctctctgtctctctctctctctctttttttccattttttattaggtatttagctcatttacatttccaatgctataccaaaagtcccccatacccacccacccccactcccctacccacccactacccctttttggccctggcgttcccctgtactggggcatataaagtttgcgtgtccaatgggcctctctttccagtgatggccgactaggccatcttttgatacatatgcagctagagtcaagagctccggggtactggttagttcataatgttgttccacctatggggttgcagatccctttaactccttgggtactttctctagctcctccattggaagccctgtgatccatccattagctgactgtgagcatccacttctgtgtttgctaggccccggcatagtctcacaagagacagctacatctgggtcctttcgataaaatcttgctagtatatacaatggtgtcagcgtttggatgctgattatggggtggatccctggatatggcagtctctacatggtccatcctttcatctcagctccaaactttgtctttgtaactccttccatgggtgttttgttcccaattctaaggaggggcatagtgtccacatttcagtcttcattcttcttgagtttcatgtgtttagcaaattgtatcttatatcttgggtatcctaggttttgggctaatatccacttatcagtgagtacatattgtgtgagttcctttgtgaatgtgtcacctcactcaggatgatgccctccaggtccatccatttgcctaggaatttcataaattcattctttttaatagctgagtagtactccattgtgtagatgtaccacattttctgtatccattcctctgttgaggggcatctgggttctttccagcttctggctattattctctctctctttctatgtgtctctgtgtgtgtgtgtgtgtctttttctgtgttccacttgactataaaatatgaataaatacatcagtagaatgtctagtgtatagaaaggtgaggtgtgtgtcacatgcagggttactgtctatacagagatacaaaatgagacacatttttctatgatttgtaatgtctaattttaatgtggtttacatgcttctctgtatcatcatcttcttcttcctcttcttcttcttcttcttcttcttcttcttcttcttcttcttcttcttctttttcttcttcttcttcttcttcttcttcttcttcttcttcttcttcttcttcttcttcttcctcttcctcctcttcctcttcctcttcctcttcctcttcgcctccttctccttcttcctcgtcctctccttctcttcctcctcctctttccccttccccttccttgtcttcctcttcttccttttcttccttttaatagttatttacttttttaatgctgtttgaatccaaaatgatacttaaggtttttaaaacatttggtttggttttatcgtttgttttacattgctttctattagaaggtatacaaatggtgtgcaaaagttcattttaggcatcttttgacagataagacaacagggtgtctttttgttctcatattttattcctcctttcaaaaatgatattttgaatgtaaaagatatttccagactatagtgaagaggcagtgacccatgctagcaccattatcagtgtttctataggttgtcatttccccatagtagtcctgctaactaataccaaaatagcacagctcagcacagataagcacactcagctcagcacagatcagcaccaatcagcatagatcagcagagctcacaacaacagagaagggatggagatatatattttcctttcttttatgttttgtgtgtgtgtgtgtgtgtgtgtgtgtgtgtgtgtgtgtgtctgaactttcaactgcttacaactctatcccaatgttctactataaggaaaagaacaggcaatatctgcaggaagaaacatgctccctaggcaagggagtggtggctacaactctcttgccctggctctagcagttatcccttgtgcctacttccttgcagtgtttcagtggagacctgtaaaattatatggaactgtataagctgtgctaatgaagttgcaagcagactcttttccccaatactccagtaaaagaagatctaaactcaggaaataacaggagtctatgtagcttctatctacgtggcattccttattccacatgttgctgctttcttgtattatagtaaattagagtagtggatgtctgtagcaactttgcaagatgctgctttgtccgggtaatggtggttacaatatacttcatctgtttaatctactccttgttcctataaaggcaagaactcacaggattggctatgttgccttagacagtcttagttattcctatagatgttttatttaaactcatcaacctttttatacttactttgtcatccaaaatacttttaattaatttattttttacttattcattttacattcctgctcactgcccttctccaagccaccccctcccataatcctgccctcatccccctccctttctcctctgaactagagagcagataccctcaagggtatatccttggcactttaagtctctgtgaagataggcacttcctctcttactgaggtgaaacagggaagcccagctagaagaacataacccacatgcaggcaactgtgagactgtgataggtagcctattttggttgaataaggcttgctctggcaacccagtagaaaactctacaagggacagaaaactgagccatgttccgagagtcaggtgcctgacaccacagagcccccaactccatgattctgtgactataagtcacatagacaatgtcccaatcttctggcattctggacagactccacccccacagttacctgactatagccaggtatgccccccacctccccatagttacctggcaacagcaaaatagcccagcccactataaaaggggctgcttgggacctccttgctctctttaagctttcacctttcttactctcatctctagccctctctctctctctttcttctcccctctctccacatggctatgtctggcctctttccttaccttttccctttcccctgcctttctgcaataaagctctaaaaccatagactgtctctgctcatcaaggcccaccatgcttgaatgatgaaatagactttctcctaaagagcaccgtctaactgtctaacctcctgccaaaaggaattcctgcactccaaccatggacacgaccaaggattctcactcctgtgagaaccacacagtgcccctcctccctgcccactcctacctttggctccaggccttaccaagcctcctgagctgccaccagggcccacattctgttctcagctcttctgtggtgtccagtggtgtctgggatacccgaggctgagaacctggtacctagaactgccctttgtccactaccagctgagctggggtccagtggcttcccacaccagacacccatccagggccacatgaaaaatgtgcagcaatccttctgtatccacccacccagagcaccagtactctggcaggatgtgggttttctcccactcccctatttttcccacacccactgccccataggcaacagcctttggtatagcccttgctccaggtatttagaacccatatgaatatcatgctgcacaactgttacatctgtgtgaggggcctatatccagcccttgtatgtcctttgcttggggttcaatctttgagatcctccaatatttgaggttagttgattttattggtcttcctatgaagttactattccctgagggactacattccctcctcctattcttccataagagtcccccagttccatttattctttagctgtggttgtctgtatctttctttttttaagatttatttatttattatatgtgtgtacactgtagctgtcttcagacactccaaaacagggcatcagatttttgttatggatgtttgtgagccaccctgtggttgctgggatttgaactcaggacctttggaagagcagtcgatgctcttaaccactgttccatctcatcagccccctatatcttttggagtcagttgttggttgggcctctcagagaatagccatgccagatgcttgtttgcaagcataacagtgtatcaatgatagtgtaaaggattattgctttgtcatgggatgcatctcaatttggactagtttttgggtgattatttcctcagtttctactccatccctaatttgtgtatttcttgtagataggataagttttggatcaaaagttttttgggtgagtttttgcctgaggttccttcctggactacaaaggcagcctattcagactccatgtctggaatgctgtgagtcactgctcaggactaccattttgatacatggtcacttctgatcattaggtctccatcagttacttgagatgtcccctactttcctgctgtaggttacagatttccattcattctaatgactatttgaccatcccaccctccccctccccacaaagggacccatattcctccattcccctcatacttccctttcccacccaggttccttgatccatctgccttccagtatcatttcattcccccttccaagtgaggctcaagcatccttgcttcttcccttctttctgtccagcctcctggatctgtggagtgtggcatggtcattctgcattttatagctaataaccagcctctcgtgagtgaatatacactgtgcacatcatattaaaactgggttacctcaatcaggatgatattcacaaggtccatccatttgcctgcaaaattcatgatgtcttcattttttttaaagctaaataaagataaatgttccttattcattctttagtttagggatatctaggttacttcaagtgtctggctattacaaacaaagctgctatgaaaaaatatctttgtgcgatggtagaacatcttttgaatatatgcccaggagtgtggtatggctatgtcttgaggtatatctatttaccagttttctgagaaaagttccaagttgatttccaaaatggttgtacaaggttgcacttccagtagcaatataggagcagtcgtactagtcgacatcagtaagactagcaccatttgttgaagatgcttcatttggaggatcggggtggatatggttttggcttttttgtttacaattaaatttccatatgttttgggggtattttggggggattttgattctatttcattgatgaatatgttattttccccttgctccacatcctcaccagaatgtgctaaaacttcagtttttgatcaaccattctgaccaatggaagatgcaatctcagtgttgtcttgatttgcatttcactgatgactaaggactctgaacctttctttaagtgcttcttggctatttgagatttttactgttgagaacactgtgtttaactttgtgccctacttttcaattgggttatttggggtgtttgtgtttaacttcttgagttcttttggagattagcctcctgtcagaagtaaggttgttgaagatcctttctcagtctgcagactgccattttgtcttttttacagcatacttagctttacagaagctttacagtttcatgaggtcccatttatcaagcggtgatcttagagctagagccattggtgttctcttcagaagattgtctcctgcaccaatgcattcaaaagtatttctcactttctcttctatgagatttagtgtatctttttcatgttaaggtccttgatccatttggtcttgagttttgtgcaaggtgttaaatattgagctattttcattcttctacgtgcagacatcagtaagactagcaccatttgttgaagatgcttcatttggaggatcggggtggatatggttttggcttttttgtttacaattaaatttccatatgttttgggggtattttggggggattttgattctatttcattgatgaatatgttattttctgtaccataccatgcagttttatccctattgctctgagatacagcttgaggtcatgaattgtgattttgttcgaagttactttactgttcataattgttttgactatccttggtttattatttttccatatgatattgagaattattgatagagttttttatatattttttcaacatactagttcattttgcagacacctcctcccagcatgtttcttataattcaatatgtatcaagtgaattttgcttaaacaccacttatattttatggcttaatttttatagatacatttattaacttttctcttattcttttgatatcaaatgtcttgttccaaaagtcctgtcttagttcagtgagttgaaaggtactgagtaattacttctatatcagatttagggcatcaagtcttaggttacagtccttgatctatttgcagatgagttttggaggctaattaataaaggtctcatttaattctctatctgtagctatccagattaatcagcaccatttagtgaaaaatttttaaattgtgttcaacacagagatgactgtatcagtatggtattttacttgagtcttcatttctattcaattcatcaatggattatgttttataacatatattgtataggttttgacacttcagctgtgtagcacaatgtgaaatatgggattgtgataattccttctgttttattattcaggatttttgggtttgtgtttgtgtttgtgtttatgtttgggtttctgtttgtgtttgtgtttgggtttgggccaacataaaacttcttcccatataaaattacaattacatttttaatttcctctgaaggattgtattggagattacattgaatgtgtgatttgctttttgaaaaagagccatttgtaaagtaatagctctgttgtttcataaatgtgggggcactttagcctctaatttcttattcagttaacttttctagtttcttaaatagtcagtgtagctttttacattttgggttttgtgtgtgtgtgtgtttctctctctctctctctctctctctctctctctctctctctctctctctctctctctccccgtgtgtgtgtgtgtgtgtgtgtgtgtgtgtgttgggaattgcattgtttctatgatttcttacatacaaccttggttgtatatgaaacctgttgaattttttgtgttaaatttctatcatgtcacttttgctgggtgtatcagtagcaataggtttctggttgcaaattaaggatacattaaatatggaatcacatcacattcgtcattttaatatctgagtttcatatatatgtgtgtgtttcatatatatatgtgtgtgtgtatatatatatatatatatatatatatatatatataatctcacattttttctcttttgctctctttctggtgataagactcctaataatgtaattagtaagagagaaagagtgaacatccttgtctcattccaaagtattatccatttattacttttatccatttattacaattctggctttgaccttattatataatgtcactcttttttttttaattaggtatttatttcagttacatttccaatgctattgcaaaagtaccccacatgctaacccacccactcccccaccctcccactcccacttcttggccctggcattcccctgtactgaggcatgtaaagttggcatgaccaaaggacctctctttccactgatggccgattaggccatcttctgattcatatgcagctagagtcaagaactctggggtactggttagttcatatttttgttccacctagggttgcagatccctttagctccttggttactttctctagctactccaatgtgggacctgtgaaccatccaataactgactgtgagcatccacttctgtgtttgctaggccccggcatagtctcacaacagacatctatatgtgggtcctttcagcaaaatcttgctagtatatgcaaaggtgtcagcatttggaagctaattatggaatgaatccctggatatggcagtctctagatggtccatccttttgtctcagctccaacctttgtggctgtaacttgttccatggggattttgttcccaattctaagaaggggcaaagtgtccacactttggtcttcgttcttcttcagtttcatgtgttttgcaaattgtatcttatatcttgggtattctaagtttctgtgctaatattcacttatcagtgagtatacatcatgagttcttttgtgattgggttacctctttcaagatgatgccctccaggtccatccatttgcctaggaatttcataaattcattttttaatagctgagtagtactccattgtgtgaatgtaccacattttctgtatccattcctctgttgaggggcatctgggttctttccagcttctggctattataaacaaggctgctatgaacatagtggagcatgtgtccttattaccagttggaacatcttctgggtatatgcccaggagaggtattgctggatcctttggtagtactatgtccaattttctgaggaaccgccagactgatttccagagtggttgtacaagcttgcaatcccaccaaaagtggacgagtgttcctctttctccacatccttgccagcttctgctatcacctgaatttttgatcttagccattctgactggtgtgaggtggaatctcagagttgttttgatttgcatttccctgatgattaaggatgttgaacattttttcaggtgcttctcagccattcggtattcctcgggtgagaattctttgtttatctctgagccccatttataaatggggttattggattttctggagtccaccttcttcaattctttatatatattggatattagtcctttatctgatttagaataggtaaagatcttttcccactctgttggtggcctttttgtcttattgtcgatgtcttttgccttacagaagctttgcaattttatgaggtcccatttgtcggttctcgatcttacagcacaagccattgctgttctattcaggaaattttcccctgtacccatatcttcgagggttttcccgactttctcctctataagtttcagtgtctctggttttatgtggagttccttaatccacttagatttgaccttagtacaaggagataggaatggatcaattgacattcttctacatgataaccgccagttgtaccagcaccatttgttgaagatgctctcttttttccactgaataatttttgctcccttgtcaaatatcaagtgatcataggtgtgtgggttcattcctgggtcttcaattctattccattggtttacttttctgttgctataccaataccatgcaatttctattacaattgctctgtactaccactttaggtcaggcatggtgattccaccagaggttcttttatccttgagaagatcttttgttgtcctaggttttttgttattccagatgaatttccagattgccctttctaattcgttgaagaattgagttggaaatttgatggggattgcattgaatctatagattgcttttggcaagatagccatttttactaaattgattctgccaatccatgagtctgggaggtctttccatcttctgagatcatctttaatttcttttttcagaaacttgaagttcttattatacagatctttcacttccttagttagagtcacagcaaggtattttatatcatttgtgactattgagaaaggtgttgtttccctgatttctttctcagcctgtttatcctttgtgtacagaaaggccattgatttgagtttattttatatacagctgcttcattgaagctgtttatcaggtttaggagttctctggtgtaatttttagggtcacttatatatactatcatatcatctgcaaaaaagtgatattttgacttcttcctttccaattcctatccccttgacctccttttgttgtcaaattgctctggctaggacttcaaatacgatgttgagtaggtagggagaaagtgggcagctttgtctaatccctgattttggtggaattgcttccagcttctcaccatttactttgatgttggctactggtttgctgtagattgcttttatcatgtttaggtatgggccttgaattcctgatctttccaagacttttatcatgaatgggtgttggattttctcaaatgctttctccacatctaacatggttatcatgtggtttttgtctttgagtttgtttatatactggattacctggaaagatttccttatattgaaccatccctgcatccctgggatgaaacctacttggtcacgatggatgaatgctttgatgtgttcttggattcagttagcaagaaatttattgaggatttttgcatggatattcataagggaaattggtctgaagttctctatcattttttgggtctttttgtggtttaggtatcagagtaattgtggcttcatagaatgagttgggtagagtaccttctgcttctattttgtgcaatagtttgtgaagaactgggattagatcttctttgaaggtctgttagaaatctgcactaaacccatcttttttttttggttgggagactataaaggactgcttctattactttaggggatatgggaccatttagatcattaacctgatcttgatttaactttggtacctggcatctgtctagaaacttgtccatttcatccaggttctccagttttgttgagtatagccttttgtagaaggatctgatggtgttttggatttcttcaggatctgttgttatgtctcccttttcatttctgattttgttaattaggatgctttccctgtgccctctagtgaatctggctaagggtttatctatcttgttgattttctcaaagaaccagctcctcgatttggatgattctttgaatagttcttgtttccactaggttgattttgcccctgagtttgattatttcctgctctctactcctcttgagtgaatttactttcttttcttctagagcttttaggtgtgttgtcaagctgctagtgtgagctctctctagtttctttttggaggcactaaggactatgaggttccctcttagaaatgctttcattgcgtcccatacgtttgggtatgtcgtggcttcattttcattaaactccaaaaagtccttaatttctttgtttattccttccttgaccaaggtatcagtgagaatagtgttgttcagtttccacgtgaatgttgggtttctattatttattttgttattgaagatcagccttagtccatggtgatctgataggatgcattggacaatttcaatatttttgtatctgttgaggcttgttttgtaactaattatgtggtcaattttggagaaggtaccatgaggtgctgagaaaaagttatatccttttgttttaggataaaatgttttgtagatatctgttagatccttttgtttcataacttctgttagtttcactgtatccctgtttagtttctgtgtccatgatctgtccattggtgaaagtggtttgttgaagtctcctactattattgtgtgaggtgcaatgtatgctttgagctttactaaagtgtctttaatgaatgtggctgcccttgtatttggagcatagatattcagaattgagagttcctcttggaagattttacctttgatgagtatgaagtgcccctccttgtattttttgataactgtgggttgaagtcgattttattagatattagaatggctactccagcttatttcttcagacaatttgcttggaaaattgttttccagcctttcattctgaggtagtgtctgcctttttccctgagatgtgtttcctgtaagcagcaacatgttgggtcctgtttgtgtagccagtctgttagtctatgtctttttattggggatttgagtccattgatattaagagatagtaaggaaaagtaatagttgcctcctattatttttgttgttaaagttggcattctgttcttgtggctttcttcttttaggtttgttgagggattaccttcttgctttttctaggatgtggtttctgtccttgtgttgggttttttttttttcctgttatccttcaaagggctggattcgtggaaagataatgtgtgaatttgattctgtcatggaatacttttgtttctccatctaaggtaattgaaagtttgactggctatagtagcctgggctggcatttgtgttctcttagtgcctttataacatctgtccaggcttttctggctttcataatctctggtgaaaaatctggtgtaattctgataggcttgcctttatatgttacttgacctttttcccttactgcttttaatattctctctttatttagtacatttgttgttctgattattatgtttcgggaggaatttcttttctggtccagtctatttggagttctgtaggcttcttgtatgttcatgggcatctctttctttaggtttgggaagtttccttctataattttgttgaagatatttactgtccctttgagttgaaaatcttcgttctcatctactcctattatccataggtttggtcatctcattgtgtcctggatttcctggatgttttgagttaggatctttttgaattgtccattttctttgattgttttgccaaagttctctatggaatcttctgcacctgatattctctcttccatctcttgtattctgttgctgatgctcgcatctatgttttcagatttctttcctagggtttctatctccagcgttgcctcactttgggttttctttactatgtctacttccatttttaggtcttggatggttttattcaattccatcacctgtttggtcttgtcttcctgcaattctttaagggatttttgtgcttcctctttaagttcttctacctgtttagcagtgttctcctgtatttctttaagtgagttattaaagtccttcttgatgtcctctaccatcatcatgagatatacttttaaatccaggtttagcttttcaggtgtgttggggtgccctggactgggcgaggggggagtactgggttctggtgatggtgagtggtcttggtttctcttagtaagatttttacatttgccttttgccatctggtaatctctgtagttagttgttatagtttctctggttagagattgttcctctcatgattctgttagcctctatcagcagaccttggatactagatctttcctctgaatttcagtggtcagagcactctctacaggcaagctatcctcttacagggaaggtgcacagatatctggtgttcagacctccctcctggctgaagatgaaggcccaaaacagaacctgtcacagaagctgtgttgcttaggcctgcacagaagctgtttgcttctgtagaccacactctcacctgcacagactagtctcacaggtatccaggaaccaagatggctcccgtaggtgctcctgcaaagccctcccgggctggactgacacctatcttctggcagggaaggtgcccggatgtctggagccttaaaagggggctgcctcagaagctctgtggcttctgcctgtcccagaagctgttagcttctgtagtccacactctcacctgtgcagagtagtctcggtggagtcctggaaccataatgtcactctttagtcaaaatatgttctctgtatttttaccagtggtcacatttttttttttaaagtgacacttcctcacctagcaaacatcaatgctaatggtcccccaggtatattactgaactataaatgagtactcttttcctgtacttggatttttttagtgaattttttgtttatgcattgactaatattgaatgcaacatgaatcatgtctaaccaaaccctgagaacagcaaatattgatagactactgtgacaatctactggttctcaaaaatttttaatgtataaatacatatttatacatatttatttacaaactttttaagatgacaaactaaaattacagagacttaatttgacttcagtacatgttccaacactaaagtatttacataaactagtattgccacgttataaacaaaattccatgatttctgaatttcattcacttctcactacaacctcaagtgaagtatcttcatcttttttcataagttgtaatttcttctatattccttacattatatcccaaatctaacaagtaaagtacttttggtttgtttgctttgtttctatattaggagtggttacttgttattttggatttgtttgcttattttatttattatgtagaaaaaactggggaacacctaaattctatcttaaaatctccacacatttacaatcatagtggaaacaaaaaacatgagtattaaaattatttgaggaaatggacttaatgttagagattttaaattaaaaatgattttttctacaataataaacctgattacagtcattttccctctactagtcctagtccctgcccacatacatttctgttattacaaaacttttctaagggctaaaaacaaagtaaaataaaaataagaaattgtcctaacataaagcaaatactaacacaatggaaatggacaaaacaacaagaaagaaaagattccaagaaaagtgcacaagaagaatgacacagtagctcacatattcaggaattctatagtaatgctaaaatggaagccatattatatgcagaggacaaagtgcagacactcagagttcatatgatctcagattatattgtttaagaaccccttattttcttggtgttccccatgtgttctggctagtacacttgttttgcctcctctttttcatggttaccttagcactgaatggatgaatttggtggagtcagtaagtttaggggtgaatgtcccaaaaactctcactctatgtataatgtataaatgcaggtctctgtatttgtttctaactcatgtagtagcccttaagacaaattagatattgcttggtcattaccacatgctttgtatcaactttgaagtagcatatctttcaggcaggatatactattttagatcaaaggatttgtgtattgcttagtgtgtgtatatctatttcagtaatgtgtagactactataggcacctacacatatgctcacatacacatacacacagaagggtgagagaacagagagacagatgctgagtgatagacagagacagaaatggggacaaagatagaaatatacacacatgaataaaattaataaaatctagctaactgtggtgacacatgactttccttccagcactttagaggcagaagctggtaaatctctgcattcaaagccagcccagtctacaaagtgtctttccagtccagctaattctaatgagtaagaccctcattagagggtcaagaaaaagaagaaagaagaaaagagaaagaaacagacataagtatctcctagcaacaatttttaaaatgagagaaaaaaattcatcacaatgaaaatcaatattgttattaaacaacaaataatatgttcataagggtttcatttacatgaacacataggaaaatttaaaagtacacctaatcaagtaaaacctgattaatgcagaacgttgttaaaggtagcatcttttaatctttagtgatttctcctgatagtactataagtatctagtgcttttgtaaattccatagtttgggttacatttttcctaagcactctttcttttctttgtatagaaatcaaatggtgaatataaatcaatattgtgtagtcaccattgcccacaaaacaccttgaatttattcctgaacaatttatataggggtttttgaagaccttcctctttcatattagcgataggagagctgacagctcatggttgcctgcattatgtcatttgctttagaaaagattttgaatccctgcagcctggcaaacatgcacgcatgcgtcgttgaaggtgtgctagctcaatagcacaaactgggggttgggtgtgtgattagtcaagtcagtgcagcaggtcctgctcagagaagaggcagccaaaggagcctgacacatccaccctaggagttgtcagcaaggcaatgcagcaaccaaggtcagctctcatagctccctcatttctttcatagttagtcatgtttcttttcacattaagtattgcaaatttgttggaattagaacattattctatagatctcaattctttgactttgatgaatcagatgagaatgctatcagatcaggaacgggcttcctttgtcttgtcctgtgttgtgttggctgcagtgcccctcccttgagccttcaatctgccctgtcacttcagttcagttctcttgcagggtgaacattaacatttcaaaaagctgacagtattgtggattattggtgtgtgggagtaatggcagccatattaaaaaaaaagaacatttgtttttatacgtggatgttgcataaaaatagcattcataagggaacttaaattggtatcttgctgtctgccatgaactgaaggatgtaaggggataaaagcatttgtgagttaacatacagattatcagcagagggaagactcaacaaaccattgtgttttgcacttcccagtttctgaatggctaggagagaatcagagaaatatgagttttgatgctgtgatacttataaaagaaaggggttttcaaactggctttaagaaagagtattggacagagagaattcagatgtgtaaagtgctaacttgtagaaacatggggtgtctttacatacagatacagtggtacagaataataaaccttttttttttctgtgatttcgtaaggtggtatggtttgtctattttgatagtgcttcactgttttaggatatgtgttgttagtatgtttttatttgaaatcttgcccagattcaacaataaacttgtagattagaaagaactttctttgaatatgtgatctatattttgatcccctgatttggatgaggtttgtaagatatgcaaaatagcctgtagattttttttttttttttttttttttttttttgccatcctccattagataaatccggaagggtctgtcttgtcacttgttatttttttgttgttgtttggttttgttttggggtctatttggaattgcattgtgtttttcattacaaaatggtatattttatgaaaataaatttttcctaatttttcatttccattcataatttttgtatttatatcatgattacagttttccttttttttactcttcccagttcctccccaacttccctccctttgagatctgctctttctgtatctcactagtaaagcacacccaagagataacaaccaaacattaacaaaataaaatagactaagataaacaaaactatcacattgagacaaggcaatccaacagaaagtaaagtccacagtagtgtcacaagaataagaaacccacttgttaactcaggaatgccataaaaacactaaactgaatattataacatatatacagaagacccagtgcagactgtggtaggttctggaacacagagatctacagagacatgaactttgctttttgtcattgtattttgtttttcatttcagaatgttgtttggttttaagatttttaaggtatttctaaagtgcaagcctgtgttgacccaagccaacagcttggtgaaggttgttgcttctgaagaggtgttaattaatacagatataaaagagtagcaccatataatacaattttgatacttcagttattatataggataaattgaaatctggcatgctgatacctcctgaattccatttataagtcatgttttttttctacagtgagtcttttttgtctccatataattttatgactatatttcttatttttttacaattaaatttcttaatttgtgtgaaggatattattggtgattatatatatatatatatatatatatatatatatatatatatatataatattttatggaacatgttggtgttatatattatacataacagtattatatataatattatataatacatattttacaaatgatattgtttctatggtttgtccctataaatatttgttattttaggatatgatttttttattaatttgtttatactgctgctttgctgaaagtaattatcagcattatgaggtttctgatggcacatttaggacattttgtgtgtagaatcatatcaaattcaagtgaaaatacattgacttcttcctttcaaacttgtatctccttgctgtctttcattcctgttgctttcctaagtcttctaaagctgtactgaataagacagaaaggataaatgtccttatcttgtatctgattttaatgaagatgctttgagttctctccgtctagcatgatgctggctctgagtttgttgtgtgtagttttatcattctgaaatatgttctgtttatccttaccagtgaccacatttctaaggaaacaggacacttgctaccctagtagccatctatgtcaataagaatgtgtgtgggtagggttggaatattgagaagccctccttctttcttacttgaatttgtgctcaatcttgtgagggatacacatgtaaccctaactgtaagaagccatgttatagagacattccatagcatttctccatgtcctctagcatttatttagtttccacaaccctttttttaagtattgcttgaccacaatatggggagttttagatgtcaaaatagacaacccagtcctggtactggactatctatctgttattctatagtgtccagtggagaaattcattgtcttgttactagttaaccatatttgaaaaaaaaaatatatatatatagtaaagcctctcttacagtagtttgcttccacatgactttttcaaaataactttaggaatatttatccttcctcacaatcactcctcaaatgtcagctttgattcctctcccctcagtgtgatggttccctcagggaatggcactattagaaggactatgagcgtggactttaatacccttgtcctagctacctggaagccagtcttctgttagctgccttcagaacaagaggtgaaactctcaactcctgcagccctacgtctgcctggactctgtcatgttcctaccttgatgaaaacagagtgaacctcttaacctgtaagccagtcccaattaaatgtcagccttattagagttgccttggtcatggtttctgttcatatcagtaaaaccctaactaagatatttagtctgtgccattagtttcccttaatatttataccattgttttctaaacacttccctcccactaaatacagatctatgatgttattactttcctgatctatatatttattctaactagaacatatatatatatatatatatatatatatatatatatatatatatatatctgtcattggaatttatgaaactggtgctctacagatgggaaagtaccatatcatgtttcaattagtggacagacttaaaagacaggtagattctggagcaggggggaaattgagccgatagcttaatatctatatttatttaccataacttaatttcataatatctataaatgataacacagcttaggaatgaggagagaattagatttcctcacaatattgtgagaaaactctcagtaatgcatttcgacatctctgtctctatatgaagtttttctttatactgtcagtaatttccaactagacctaggacttgtatggtatgttccatgtaaccatgttttatacatttgtatcacagatgatgaaattacttctctgatctagataggaatacatatctctggcctgttgcactcaaccttccacttgtagacacagatgtttcatttcctatatactctgaaggagatagagtttttaaagtgtttttgatcaagataaacactttaaaagaccatactgagagggaaggttaatactagtaattaagattggcattttagcttccagtttctgtctgcgacctggaattgaccctgtgccacaactctctatactgaaatcccaccatgagagagctgttatctcaggagtgctgacacacttgagagcacaggtaataccaccacttctactcagggaactgcttggagccctcaggacacaggaaccaaggagtaccctgagacaggatctttctggtttctatctgagactggacctgaccctgtgccacagatttaatactcaaatctcatggccaggagagagctggtccccaaggagtgctgatacagagccttacaggagggacaagccacagtcatagacagcaagacaagctaacacaacagataaccatatgtcaagaggcaagtgcaagaacataaacaacagaaaccaaagttatttggcatcatcagaatccagatcttccaccacaagcaagccctggataccccaacatatcagaaaagcaagactctgatttaaaatcacttcttatgatgatgatagagggctttaagaaggacatatatgactcccttaaagaaacacaggagaacacaggtaaatcccttaaagaggaaacataaaatcccttaaatatttacaggaaaacacaaccaaccaggtgaaggaattgaacaaaatcatccaggatctagtaatggaaatagaaacaatgaagaaatcacaaagggagacaaacctggagatacaaaaccaaggaaagggatcagtagtcatagacacaagcatcaccagatagaagaatataaatattgacataacagtcaaagaaaatgcaaaatgcaataagctcctaacccaaaacatccaggaaatccaggacacaatgagaagataataggcatagaagagagtaaagaatcccaacttaaagggccagtaattatcttcaagataattatagaagaaaacttttctaatctaagaaaaagatgcccataaacatacaaaaggcctacagaactccaaatgtattgtaccaaaaaagaaattcctcctgtcacataatagtcaaaataccaagtgcacaaaacaaagaaagaatattaaaatcaataaggggaaaaggtcaagtaacatataaaggcagatctatcagaattacactcgtgagaaatacatctcaccagagactgtaaaagctcaaagatgctgggcaaatgtcatacagaccctaaacaaacacaaatgccagcctaggctactatacccagcaaaactctcaattaccatagattgagataccaagatattccatgacaaaaccaaatttatacaatatctctctacaaatctagccgtacaaaggataatagatacaaacctccaacacaagggaaactatacccaagaaaaagcaagaaattaatcttctttttaaaaaaatgcaaaaagaaacagccatacaaacataattccacctttaataagaaaaataacaggaagtagcagtcactattccttaatatctcttaaaatcaatggactcaattccccaataaaaagacatagattaacagactagataggtaaacaggacccagtattttgctacattcaggatctttaccaatcctacatccaatagagtgctaatatccaatatatacaaataactcaagaaggtagattccagagaaccaaataacactatcagaaaatggggttcagagataaacagagaattctcagttgaagaaactcgaatggccaagaagctcctaaagaaatggtctacgtccttagtcatcagggaaatacaaatcaaaatgaccctgagattccacctcacaccagtcagaatggctaagatcaaaaactcaggggaaggtgcatcatctctgaatgaacacagacccagaagtcctcgactgtatgtgtgttgggggcctcatatcagctggtgtatgctgtctgtttgatggtccagtgtttgagagatctctggggtccagattaactgagactgctggttttcctacaggattgcccttctccttggcttcttttagccttccctaattcagaaacaggggttagctgcttctgtccatttggtggatacaaatatctgcatctgactctttcagctgcttgttgggtgtttcagtcataataggtccctttttataagcactctatatcctcagtaatagtgtaagaccttgggacctccccttaagctggatcccactttggacctattatccttgggctcctctccatttccttcctgtagcccgagggagtttagagatcagatggggtgggaggtgggggcagccatgtgaagacagaggggtggggaggaggggttggatgtagagcagttggagagtgaattgggggggggcaggaaatagaatatggagtgtaaaaagtacattaatttaaaaaaataaaaaaaaacacagcaataaaaatgggataaacatggctaaacacacatggaaaatatcagaaaggaaacttttaagtaccagtgttgtatataatttagttgcaataattgggaaaaatcttaaaacaaacaaacaaaaactcaggggaaagcagatgctggcaaggatgtggaaaaagaggaacattcctccattcttgatgggattgcaagctggtataaccaatcgggaaagcagtctggcagttcttcagaaagtacctgaagacccagatataccactcctgggcacatacccagaagatattccaacatgtaataaggacacatgttccactatgttcacagaagccatatttataatagccagaagctggaaacaacccagatgcccctcaatagaggggtggatacagaaaatgtgatagatttacacaatagagtactgctcagctatcaaaaacaatgacttcacaaaattcacagggaaatggatggatgtagaaaatatctttagtgaggtaactcagtcacaaaagaacacacacaatatttactcattgacaagtggatattaggccaagcacatggaatacccacaatataactcatggaccacataaagctcaagaggaaggaatgtcaaattgtggatgcttcagtcctacttagaagggagggacatgggaagaagagagaagggagaggggaaaaagaggggcagaatcgggtatgggaggagatggaggagatgtacagagggtcaggaatttaaacagaggtctggctgggcagtggtgtagcacgcctttaattctagcacttgggagacagaagcaggcagatttcagattttaaggccagcctggtctacagaatgaattccaggacagccaaggctatacagagaaaccctgtctcgaaaaacaaaaaaataaaaataaataaaaataaatgaataaaaagctttaaacagaggtgtgtagcaatggggaactaggagtagcaaccagaaagtcccagatgccaggaaagcaagagcctcccaaaagccaatggggatgacattagctgaaatacccccaaaaggggcaggagaacctatcagaccatatgcagaagttaggtatgtctccttggttgaggaatggtgtcactcgcccatctcaaaattttaacccaggattgttcctgtcgaaaggcaatacagtgacaaagagtgaagcagaaactgaagaaaggacatccagagactgccccacctatgaatccatatcacatgcagacaccaaacaagacactattgctgatgccaagaagtgtttgcttataggagcctgatacagctgtctcctgagaagctctgccagagcctgaaaaatacagatgtgaatgctcacagccaactattgatctgagcatagggaccccaatggaggagttaggggaaggacttacagagctgaaggaaccttatctgtcatcaatgggagggaaggcccttggtcctgtgaaggtttgatgccccagtgtagaagaatgctagggcggtgaggcagaagtgggtgggtgggtgggtgagcaccctcatagaagtagggtaagagggatagaatagggagtttacagaggggaaactgggaaaggggataacattctaaatgtaaacaaataaaatatccaattaaaaaaaaaagattggcattttaaaatcctgtattgtgccctgggtgatgactcgttatttaagagcactgagcactcttcccaaatacctatattcagtttccagaactcacataactacaaaaacctgtgactccatttcccaggaatctgaagaattattctaacagcctcaggctcggtgcacaagtgctgaacagacatacatatagacaaacattaatacataaacttaaaaaataaataaaatctaaaacaaagaatgtgtctatttaattgtcctgttataaagagaatttgggtctacttggaaaaaaatccctttgaaaaactgatgacaaactttaaatttatcacttcaataaattctgacattgtggaaagtcaaaaatatgttaatgtatatgttttgtgtcatatctttatgataaaaaggaattcctgattatatatgctgccccatttcactccccattgtattggtctttccaatttgcctgaggaagttgatcctggtctagcattgaaaacagtgacaaaggtgaaggagaagcaggttaagagtcaagagaacatggccctgagtgttgcctaattagagctaagaacaactcaaatgaaccatagtatgaattcaggttatcaataggaaagcagattctaatatgataggggctagatatctgcccagctatttgctgataaaggtttattgtgaatataaaggctgtgggtgtggttttttgtttgttttgttttttgtttgtttgtttgtttgtttgtttatctaggaactcaattaccaaaggcagagtagaaaccctggactgagaattaaatgtcttctacaacaaagaactttctccacttcatttcaaacaaggactgaggtaacagctctatatactgacttaatatagtctatcactatttttttttttgagacagggtttctctgtgtagccctggctgtcctggaactcactctgtagaccaggctggcctcgaactcagaaattgaaatccacctgcctctgcctcccaaatgctgggattaaagtcgtgtgccaccattgcctgacttagaactccatccttaaaaacagaacagggatattaaactgcacatccatggcaacgaatcctggagagcatttatcatacacaggtacagaatactctcattgtgtattagagaaaggacaacaatatatctgcctttgaagaaatgaacaaagacagaatatttcacctaaacatttttttctaaagtatttttagacttacatattttatatgtgcaattttcttggctacatgtatgtttatgtactacatatgggctttgtgcccattgaattcagaaacaggtgttcaatccctgtaatgagaggtatgaactattgtaaaccatgatatgtgtaccaggacccaaattcatactctttgcaacaagaacaaatgctctgaaccactgaatcatggatttttataggctcctggtaaattatccagaaacaaatcatcatataaatgtgggcatgatattgacttgatgaagaaaacattttttgtgtataggtccttctgttttgagagccattttctatgccttttaaggattcttgaattatcaatcatagtgttggtggtttttatcattctgatttgaagctttttctcacaaaaatcatcaccatcttcattgtcatcatcattattatcatcagctagtttacgtattttcatttaaccttcctacctcttttgggaaaatagtacttacagacatacttaagggtattaaactcctcacatcttattctgtatttttttcacagctactatatgttctccacttacatgcacagttcttgaacaataatccaatctgaaaatagaaggtaatataattccaaagcccacaaggaaacttgaatgtacatattttcctatatgccaggattactataattggactgacttccttctttgttatctctgtgtcttaaggtttctattgatgcaacaaaaacaccacgaccaaaaagcaattggggaaaagggggtttaatttaacctacacttccacattgctgttcatcatcaaaggaagtcactactgagcaaggaattggatgcaggaccatggagaatggctgcttactgactagcttcaccagatttgctcagcctgctttcttataaaacccatgactaccatctccatgaggttattaatcagaatgtgctgggccctcactcactgggtccttatagctgtgtccttataccttatagctgggtctcatgaaagcatttcctccactgaggctccctctcctctaatgattttgtgtcaaattgacacacaaaaccagctggtacaactaacccgttattcacttgacgcacaagcacatcactatcaaggcacaattttccctttcttattcacccccaagatctcacattaagaacataaataattttagaagtctcacaatctttacaaattcaagcccagtaaaatttcagttcctttaaatcatccaatctcttttaaaacccgaagtcttttcaaatttaaaatttcagttgtgggctccagtataatacttagtctttcataggctctcttcctcatgtcaaactttttctttgcatgaccccctcagtcctgggcttcaagtgtgactcaggattcaccttcatcactggtctctcctagccccgtacagttccaagtcttagctgctcttcatggcaacttcatgccttcaaaaccagtactgccagggtgtttcttacagattacgaagtctaactgacatgacatacagtccaactgacatagaactttggctacctctggaacacagcttctctatgctttcaggaaatgatgttgttctcttctttttttttaattctttttttattagatattttcttcatttacatttcaaagactatcctgaaagtctcctatacctccccggccctgctccccaacccacccactccaaagcccatacataaacataataagaacaatatacagcaaaccaatagccaacatcaaactaaatggagagaaacttgaagcaaacccactaaaatcaggtactagacaaggctacccactttctccctacctattcaatatagtacttgaagtccttttcttgatcaatcaactataattcttagctgcagctaaccaggatcaattgctttagtaacacaagtgtttcctttcagtgttgctggtttcctgttaatcatgtctggccctttagctccaactcaccagaatgacagtctcaattcaaaatggtaaactgttctgatatactctttacatttcactcaaagttgacaagttagacctccatcttctgcactccttttaacattcttgtctttcaagctcaagaaccttccactgagctctcagcactcaaaggcttttgtatcccaaatctccaaagtcttttctcaatcctcctcataacatgttcatctctgtcacacaataccccacaatcctagtaactacttctctccttagatggggatttagcctccagcaggctccactccaaatgctcctgatgatcttggtggtaaagagacaacataaccatggcaacacttataaaatcaaacatttaattagggctggtttgctgttcctatgtttatcccattattgtcatggcagaaggcatggtggcatgcaggcagatatggatctgcaaaagagttcaacatcatgaactacatgcagaaggaagtgaagtggctgagcccttaaagctaaccctcgccgggcggtggtggcacacgcctttaatcccagcacttgggaggcagaggcaggcagatttttgagttcgaggccagcctggtctacaaagtgagttccaggacagccagggctattcagagaaaccctatctcaaaaacaaaacaaaacaaaaacaaacaaacaaacaaacaaagctaaccctcacagtaacacatgaccttcaacaaggtcacacctactccaacaaggtcacacctactaataatgtaattccctatggaccaagcattcaagtacatgaatctatgggagccattcctaatcaattcaccttactctgcttcaacaatatgttcttttgctgcagccctgaaagtgatcactcttggatggtattcattttcatcattagcattttaaagtgataaccttttctgtgctttaatgtaacacaaaatgcctggcagtggaattgaatccctttaatactagctcttgggagacaaagcaggagggtctctatgagttcaaggccagttttgtctacagacgcagattcaggtcagctcgtgctacacagaacactcttgtgtggtggtttgaatgaatgattggcccacagagattggcattgttaaaaggtatggcattgtttgaagaagtgtgtcactgtggggacaagctttgaagtttcctgtggtcaagcacagtgtgacacatagtcaccttctgtttcccacacatctagacttgtcagatgaaagaattttcagcttgatttctaacaacttgctggcaggctgccaagtttcccaccatgatgacaatgaactaaacctgctacatgccagccatgattaaatgtttctattataatagttgtagtggtactggtcagtcttctcagcaataaaacaccttttcttgaaaaaaaaaagttttaagttttcagtgattatgtccatagctatatagtcttcagtgatatgcaggcctataaaggtagtttaaataaaggaagcttggatgatgtaacttccagccagtcattagaacagacacgtgacatactcacagaggatttttgtattattttttaaaattgtgtattgtgggccacccaaaaactgaagaaggatttgttgcctgactataggccctgatcctctaactgggctgccaaatttgccctcagtggcagaagatgtgcctcaacctgcagaggcataatgtactagagtgtgttggtatccagggattgattgacccttctcagaggggaaggaagagggagataggcagatggactatgtgaggggaaatgtggaggtgggctgaaatatgggtgtaaagtgaatgaataaattgatcaatggaaaaagaatcctgtattaataactgaaaaagcagtcagttacattaccatcaccaaagttattgctaccctaataatcaaatattctctctgtattattgtatttcacactgtttcactcagcaaattttatgtatcacttacttatctaaagtatttccatactgccttaataagtagcaagatgaaatcatttattctttatgtactaatgattgccatgtttcctcatttgagatatatttaaaatttttctcacatttatttattcattgttcatatatctgtattgatgggtggcatgcatgacataaagaatgaaaagagtttaggaatactttgagagagttaggcatctccttctactatgtgacttctgggtattaaactcagatcacagaagcaaatttttagaagcaagcacctgtactttctatgccatctttccatcttggtcatactattttttacatcacttcttgtgatattctctcccttattcattctctctctctctctctctctctctctgtttgtgtgtaacaataataattatagaagtgattagagggggagtagagggcattggaggtgtaagaaagtgaagaaggaagcatggaatgatgtcaacaaagtagatttatatgaaataatcagaaaaagaaaacatctatgtaaaatgaatttgaaaagaaaaaaatgattcagcattttatgaatatagctttttttagatgaagaaagaaatgtaagactgtctttagaattttacatttcctgttagtgttgaaatgtaaacagaaaacctctctcttgtttcaggagaccctgtgttcctcactttacgatgggatgaaaaacatcactttatcgtttctttttgctgaagcagcaaaatggccatattctatccatctcagttttgtccttaaatatatgaatatttccaagggtcactttgaacataaattttaaaaaaaaaatcactttccacatgttcccttatcatcagtttcacttttcttcccttgactctcctctggtcaatgttttgtttattatatggagagaagggtaggcagaggacaaggagaaatattgaatgtatatatgacagtttggataggaagcttctaaacagcgagcctgttctgcattaacaaagataagcactattcagtctgtagtacacgtgcatagacttacatgaatgcttgcacaattcacggatataaaaaacttgtccccactaccttctatatacaattacaattaacaagaagagatttaactgctttttttctgagagcggtcactgtctctatgatgactagaagtcctgaatgtttgagctggagggattggaggaaataaagggcagaatctggattggtctgcacactctgagttcccttttcaatatatattcttttcaaagaaaaatatatatttcttttatgtatatgaataccagaagagaacatcaattccattatatatagttgtgagctaccatgtggttgttgggaattgaactcaggacctctagaagaacagtcagtgctcttaaccactgagcaatctctccaacccctcaatatatattcttaaatggaggatttataaaaatctttctctctactacattactcatttctgttttttcctggatgtttatcaccaacttagaagaaataatataattataatcttttgtttttgtttttgtttttttgagacagagtttctctgtgtagccctggctgtcctggaactcactctgtaaaccaggctggccttgaactcagaaatctgccacctctgcttctcaagtgctgagattataggcatgtgccaccactgcccagcagaattataatttttaaatattaaaatttacaatccaaagcaaatgttaaataaagtcatgttgaacattcagaacttcatgaaagtacatatatttcatgaaattaaaaggggaacttgttggaaataagtatttccatgggagaaggtatggagattagaaagtgtaactggatgtatgtgactaaagttcattatgtttatgtatatatctgtcaaaaataaaaaataaaataaaaaaaaccaatgcctcagtagacaaaggtgattgctattctagccccggcaatttgagtttgatctctagaatatatatacacatgcacatatagtgaactggctccccaaatttttcctctgacctttacatgtgggtatggtatgctcacacacacacacacacacacacacacacacacacacacagagagagagagagagagagagagagagagagaataaattctgtgtgtattcttcattggagtctgtctgtactatttttcactgtttataatacttttgacactaccagactctcttccacaatgacccctgaaccttgggaggaagagtatgatataggcattttattcagtgactagaattgagcaatcttttattctctgcattttgaacagctgttgatctctatgctaagcacaatgtgctaaaaaaaagaactgtctctcaagagggttgaaaaatacacttagctatgagtataaagataagtcattaggaggtagattaatactatgttcatttagcagggtaataacatttgactttcccttagggatatggtctgtttggctaccagttttggggccatataacagggcaatttataagtttcaaattggggagcaggccttaaatctagccagaatgtaagttggttattctcataacattcatacacctattgcatcagtaggcaatttttccaggcctgttagtgttgccacttgcttgattcacagctatgtaaatggcacttgaaattgtttttaaagaagacacaaaattaaatgggtagggaaagactgcatctgggagaaatgagacgaaacagtgaatatgatcaagccacactatgaaattcacaaagaacaaataaagtgagggaatagatgcatgaaagtttgctgatgccatatcatatttttattatatcaataaggacaatgtttctttttttaaaggtttatttatttattatgtaagtacactgcagctgccctcagacacaccagaagagggcatccgatctcattgcagatgtttgtgagccaccatgtggttgctgggatttgaactcaggacctccaagaagagcagtcagtgctcttaacaactgagccatctctccagcccaggacaatgtttctaagagagataaataagtagggagagagagagaaagagagagagagagagagagagagagagagagagagagagagagagatctttgttgaaatggattatatagacattattcagtcaattactaaagattaatatctcaaagagtcactccacacttgttctttattctttatccatttttcctgtaccacattcagtggcagttgtatgcatgtgactatttgttgttgttgttgttgtttttgatacaggggttctctgtgtagccctagctgtcctggaactcactttgtaaaccagattggcctcgaactcagaaatccacctgcctctgcctcccaagtgctggtattaaaggcgtgcaccaccacgcccatcgcatgtgactttttagttagcatcctttcaggaatagaattatatccatgtttatactgatcatatcactaattaggatttgctccaagccaatgcattggtacctaacctatagttacaaaccaagacttctgacctgaggaccatatttttcaaagaagaaaaactaacatagactgagcagttaattttttcactacatgtctaataatgagaaagcccagaaattatcctcagaatcacattttctaatgaaaaaatgttggaggcttctaagttgtcacacgtaattcattttccacatgttagttacaagttgatctctagcatctagtatgtgagctttgattaccaaaaacatttctatgcatttttgtgtaagtaacacagtgtggcttcctctctccttaatttagacagaaattaagagttaagtatccaccctgtcaggcagtagtggcacaagcttttaatcccagcacatgagagtcagaccgacctctgagctcaaggacagcaatgtttacagagaaacgtccatgacagctaaggttacaaaggaaatcctgtttcaaaaagcacagaacaaaacaaaatattgagcatccagccaggtgcagtggtaaatgtctttaatctcagcactggggagaatactaaaaataagtgtgattggcatctctctctttcaagaaaaatgtgttctgaaaagtagaaagtcctattaccatacttgacagtctgttatatacatactaagatggagaatatggtgcagaggttcagtatagctataaggataaaacatcaatccttatcctaaaaaggaggctgagtttgctgcatgacttttttttttttatatcaagatgattgtgacagcactcaattttactagcagtactaaaaaggaaagatgtaaataccaagaggttgggccgtggttgcacacacctttaatcccagcacttgggagatagaggcaggaagatttctgaggccagtctggtctacagagtgagttccaggacagccagggctacacagagaaactctgtctcgaaaaacaaaacaaaacaaaataccaagagaaaaagtgtcatcttatgcacattttcttaattattgtgtaaacttacccatcttcattgactggatatatttattgtcggtacaattgttttatacagtcaggtactatacaccgatgtataggattgttatggattactgggctgtgtatctggagaagatttggtttctgcatgctctagtcattaaatggtgctacttaaatataagatgggtaaaaataaaaggaaatattggccaatttgtaaagtcaaagctgatacctgcaaacccagcctcagtaaggtctatggctttttcagtaatttaactgcatatcattttcattaccttcatatcaaaaccataaaaataattaacactcatttttccgctttaacttgctaacaaatctaagaaacatatctgaatttgttcctaaaagcacatcatctatgtcatcttcctatgtagatctgcatgattttgccacttatatcatttctaacctccaggcttatactggaaagcatacctgtgcagaaatccatttgaattagttcccccatacccaaccctactatgactctgattttctatacagttgccagttttgaatctctatgttagttatcatatacataagaaaagaagcatctctaaggatgtttgaaaggtacactaatctgtcttacaataagacatggcagtttgttttaatactgcatgggctagacatatttaattttgacagaagatagagtcaccagaggaaagggatcctcaactaagaaagtgagcccataagcttgtgctataggaaagcctataaagcatgttttaagtagtgactgattggtgagaactcagcccagttgtgtgttgtgtatctctgggcaggggttctgggttctacaataattcaggctgagcaagaatgaggagcatgccagtaaccagcagtcttccatggccatcacatcacttgctacctccagttctctgccctatttgagtttctaacctcactttattttgtattgtttttttattagacagtttcttcatttacatttcaaatgctattcccaaagtcccctatacagtccccctgccctgatccccaacccacccactcccacttcatagccatggcattcccctatactggggcatatgatcttcgcaagaccaagggcctcactcccattgattgctgactaggccatcctctgctatatatgcaactaaagacacagctctaggggatactggttagttcatattgttgttcctcctacagggtttcagacctctttagctccttcagtactttctcaagctccttcattaggggccccgtgttccatccaatagatgactgtgagcatctacttatgtatttgcgaggcattggcatagactcacaagagacagctatatcagggccctgtcagcaaaatctttctggcatatgcaatggtgtctgggtttggtggttgtatatgggatggatgcctgggtggggcagtttctggatggtccttccttccatctcagctccgaattttgtctctgtaacttcttccatgggtattttgttccccattctaagaaggaacaaagtatccacactgtggtcttccttattcttgagtttcatgtgttttgcaaattgtatcatgggtattctaagtttctggactaatatccacttaccagcaagtgtatatcatgtatgttcttttgtgattgggttacctcactcaggatgatatcctccagatccatacatttgcctaagaatttcataaactcattctttttaatagctgagtagtactccattgtgtaaatgaaccacattttttgtatccattcctctgttgagggacatctgagttctttccagcttccggctattataaataaggatgctatgaacatagtggagcatgtgtccttacctgaccttctttgattatgttcagtgatatgaaagtgtaagccaaataagcactttctcccccaaactgcttttgatcatggtgcttcataacagcaaactccctcaaactaaaccaaggactatgtctctttatcagattatcatagtgggttgttggtcctgataattgtattatatatatgtttcatcttgtgaaggggatcttaagttagaacgtagcttgttactcccatcaagtcctgtccactatttcaacacagagcaatgaaaaagacttttccaggtctatgaaacttcactactccacaatgccaaacaaaaatggtaaaaccattcctggcacatgactttttaattttcagtcctataatatataataggagcatagttctcccataatatggtaacatcattaaactattaatatctgtgaatgtgtatattttaggagactctgaaagattagtctctcgtgactttttcggaagttctttagtattattttttcctcccaatattgctttctttaacctacttccccttcctctaccacaatagcatcctttctgatccaagattcctctttcattctggttattatcgtgttatttcttccctagattgaagatttcttatagtgcagacttttgagaacttaccatgatcaagcttttctctgactgtgttggatgtagctccacaatgcgttcttaagaaaaccatatttgtatatacatataatttgaatattttatcacttatttggttacagaaatcatgtgtggcaacatatttaggtgccttgtctgtaaattattaggttttatgtttgtttgtttgttttttactttgaagtatttttcagtatcttggatggtcatttttattctccttttaattctgctgaattaattttaaacactggctgtttataaacaaatatacacattagatatataattttgatcgtatgaattcatttttacattttttgtgattacagaggcaagagatgaagaaatttgtgtaccatctgtgataccatgcctataattgatcttaaatgatcacgtgggctttccataattcactatcaaataacaatcagttttagtttttcaactgaatgtgcattatttttaagtattctgtgaaaaatgtaaatcctggtagaggtgaaaatcagaatatgtgattatgcattgtaagaaggttcatgttggcataacacactgactctgtgtgaggaatatatcgcctcaggaaatattacatgtatctctcctcagagctcctttgaagaactaactactgagatgcaaaggcttcctttcaagaacatccaaagacagtcgcaatggcagagaggtagcgatcacagaaatcaggctgttcatatggagagattaagcttaacaaatccagtcattacttatggcaaggaccaggttaggagattcagtgaatgaacaattattaaccaatataaaatttaggctagaaattttaagtgtgatctcaaatcgcttgtgaaatgctggagaatgaaaaagctaatcttataccaattattcgggagttttgccagatcaagttgccaggatccttacagaaactatgctttataagtaaatttggagaggagatgggtgatatttcatcttgttaaagcagttgcctagcatgaacagatttggggttgaccatcaccacaaatacaggcaggactctacacacaagtgattacaacacttaggaggtaggtgcagaagaatatgaagtttatcatttttctggacaagatgagtccatttcaaagaaaaattaatatatgtctgtaccattgtatgatggaaatatgtaccttaattttttattttacaggggttacattaaagtactgacttgagttttagaagagagtttggactttttaacagtattgattcttttaaacgttatgaagaattttgtttgtttttcaaaacagactctctttatgtagttctgtttgtcctggaacatgtgctgcagaccaggctggcctcaaacacagcgatctgcatgcttctgtctcttaagtactgtgattaaatttgtgcaccataaccacctggcttacaaggaattttgaagttgaattaaacatattttgcattatggtgtggttttgatactatgagagccaaggagtgaaacctggtggtttgaatgtgataccccctattattcataaatattcaaatatttgaccctgattggatgtttatttggggaagataaaggattgtggcattgctaaacaaagtatatcccagaggatattctctgagcttctacaaaactcatgttatttcaagtttgctctctctgcttcctgtctatgacttgaaatgaaagttataagcagcagcatagcttcttgctacctcttctcctccacagatgctatctggaatcacaagcctctaataaatgcttttctataagttgctttggttttatcacagcaatagaaaatgtgactaataaataatagaaagagagattttaagaggaagaaaggaaaggagaggagattggagggtaagtgaagtgagagaagagaagaggagagaaggagaaggggaggggtgaggaggggaggggcaaggagaagagagaggtgactggccggttttatgactggtcttgagaaaagttaggtctgtatttttaccatgtagaaccaggtagttagatttggaagtaacttaacctttgagcaatctctccggtccccaaatacaaagctttatgtaatatttcctttccaccaccgtatatatgtcttactttcaagtaacacaaggaactacctttcatgagttttaggtttataaactgctcttttaaactgatagctattctgcttggtagttcttaaccaaaaaaatatgttaataattaaagggaaaattatgaatgtattctatgacaagaattttctccactggttttgcttccagatcacagaaattaaaaaaaaaaaagattctcttatgtgaaaagatacaacacgtattttagcattataccagctgatttgatgtaaacttaacagattaaaatcacctgtgaggaagaaataaaaaattgggcaaattccttataagatctggctgggggcaaggctgtagagcattttcttaattagtgattgatgtgagaaggttcagccattctgggatattgatttccctgggatggtggtcctggattttgtatgaaagcaggctgagaaagccatgaggacttatcatgtaaggggggctgtgatacactctattcatcagcttctgtctccagattcctgccctgctggagttcctgctatgacttcctttgatgaagccctaatgtggagtcgtaagcaaaaccaaccctttttctccctgatttgcttttgatcatgtttaccacaaaaatagactgactaagacatccagttttcttcattagcctctgttttcaggaccactatttaatttaccacctctgctaacctgttttgtggagcttttgattttttttccttttaatcagatacattttcagtgctcaactacttgtacttcatttataattgaatactgggactggtgtgttggattagtagttatcctaatttttgccaattttgaagaattgaaatcaattcccagaatagaccaatagtttagtgccacaagttctgctcagcccccgacacatgcatgttatcacatgtaaacaccatgcacacactgaaccaatgcatcagtgggaatttacagtctcactccaacttcactttgagaatccctagaaggagaaactagtaccttagttcatttctgcatgatcctgcatacagagtacaaccagctatgaagacagctaactgattaagagtaacttaggaagatctaaggattgctaactcaaaagacatataggagtagtgatcccctttgcaactttattttttacttctttgtgtcttccaggcctacttcagcatgatttctgatatggaaatgtctattcaacaatatatttctgctgtacatacctgtcaagtgttgtggtttcaatatcattcagttcaaaatgaactgttcaagtcacatagaaacttgtcccaaagttaagcattaaatctatacattttactttattttattcatgtttgtgttcatgtgatcatgtctagagtgctcagagcatccaaaaggaagtgttaggtccccagaaaagaaggttcatgaacctcttggtatgaaatgtatatgctggggtctgcattcgaattgtttgatgaagcagttcttaacttctaatctttctctctccctctttttccccttgtttctccttctccctgcctctttctccctagccctacccatgtctcctagtttttgagacagattctttcactgaactcagaacttgctgaattggctagactagccagtcaattccaagatcctgctgcctctcttttttgtttctggaattacaggtacatgttgtctacaactatttctcatgggttctaaggactcaaacgcaagctctgcatgcttgtcaggaaagaattttattgagtagtctatctccccagatcctgtattctttattaatagaaatagtcattaatgcttttaaaacaagtgatataaaacaaccaaattcataaaatccaatattcatttaggaaattgatcaatatttattcctttagaagcactgtttgaatttcactattcttttttattttggaatttcactaatcttattgttgctgcatatgtatatgtagagcttgtgagtagacggatggtgtataagctttggcaaacatgtagaggccggtgagtaactttgtaaaaatatattcttttttttttttcattttgatgtatgctttggtgattagattcactagaaacaccctttgaatttattattattattattatatatgtgcatttgtcgtttgtgtatgtatcgatgtttgtatgcctctatacacatgtggaggccagagagtacctttgtgagattcattcttccattccacattcatacgtgttttgagaagtgaattcagtgtgctaagtctatggagccggtattgcctgctaaggcatcttgttggcctctgtcttataaactctcctttttttttttggtttttttcgagacagggtttctctgtgtagccctggctgtcctggcactcactttgtagaccaggctggcctcaaactcagaaatccacctgcctctgcctcccaagtgctgggattaaaggcgtgtgccaccacgcccagctataaactctcctttttaaaatttgtttttctcttatagtttagagattatatcatttctctcttacctttctccctccaaaacctcccatatgaccgtgtttgttttctttctcattcatttcatctttctttcattaattattgttcaaatactgtgtgctatatttgtctactttatctagaaaaaaagaaaaagaaaaaaacagaaccaacaaatttgaatgtgatcagagtctttctgtagagatcagagttatatccatatcttattccatattttataaaatcatgttgtttaaactgtccctttccctaaataagtacattttataaaacagtacaatattctatttgatataaatgctgaagcagaatgtagctgtatcatggttttccatataaacacacacagtctttgcagcctgaaccactaggcaaatataagtaacttattcatatatacaaaaaatgactaccatcagatttctcaaggtaaatcaaaagcacatgggaggcatactacaaagatctgaaaactcagatatgtgagcaccagacccccatgcatctgtgcctacaccaggagtaagccaggactgtgatatggaaagcacactcaccagtcataatgtcactcatcacaaaccatctccatggaatttgccacaactgaggatttataccttattattagttagctttctgttgttttgataaaacactgacaataaaagactttgggaggaaagggtttattgggtctgtactttctctttctttgagacactcaagtcaggaacttgaaagcaggacatagtgcagagaaactctgcttattgacttgctcatcctagctgctcaacctgtttctaatagaacccaggtagaaatgcctagggatggcaaaaacagtggcctgagtcctcctgcatcaatcattaatcaagaaaatactaccacaaacttgccaatttgatgagccattttctcaattgaggttccttctgcacagctgaccatagtttgagttaaattgaacaacaagccagaccacttctgtaccctgaattccaaacttctcagtttctaatgactgtgacacaaggtccagtatcccccggaactcgtgtctctagctgcatatgtatcagaagatggcctagacggccatcagtggcaagagaggcccattggtagagcaaactttatatgcttcagttcaggggaacaccagggccaagaattgggagtgggtgggtaggggagtagggggggatggtatgggggacttttgggatagcactggaaatgtaaatgaggaaaatacctaattaaaattaaattaaaaaaaaaaactttctgactggaagctctggtggtactgtttggttcatattgttgttccttctatggggctgcaagctccttcatctgcttccattctttccctagctcctccattgggaaccttgtgctcagtccaatagttggctgagagcatccacctctgtgtttgtcaggtactggcagaccctctcaggagagagctatatcaggctcctgtcagcaagctcttgttggcatccaaaatagtgtctgggttttatgactgtatatgggaaggatccccaggtggggcagtctctggatggtcattcctttagtctctgctccacactttgtatctcctcccatgggtattttgttccctgttctaaggactgaagtaagtatccaaggagctaaagggatcttcaaccctataggtggaaaaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaatttatattattggttagagtttttgttgctataataaacactgtgaccaaaggcaacttgtgaaaaaaaaaaaaaaaaaaaaaaaaaaagagtacacatggagggacctatagctccagctgcatatgtagcagaggattaccttattggatatcagtgggaggagaggcccttggtcctgagaaggcttgatgccacagtgtaggggaattccatgacagggaagtggaagtgggtgggttggtgagcagggggaaggggagaagatatggggttttcagagaggataaaatttgaaatgtaaataaagaaaatatctaataaaaaaattgagtgcccaaatttgcatttggtacctttccaccttggagaaactttatgtctgccttgatatttatacagcttcttacatgggccccatgtggggcttttgcttacaccaactatagccttcagtgaagcccctttgaaaccagtagtctctttaacacttttatattcaatttgtaatctagtcctctctctctacctctctcttcttctccctttcccttcctcctctcccctcttctctcttacacacacatacacacacacacacacacacacacacacacacacacacacacacacacacacacatacacatactctactttgtgcagtaatctaagaattaccatttataatcatgattcactcattagctctgaaggcctcagagcttctcatgcttaaggtctagtggcttcttccttcaaatcactgggtttagagcaaatactggcaccctatgttctcacaaaatgtgtgcgtataagcccgagaatcatactagcaatctcacacttttgaaacaaatgaatgatacatctaaattccttgtatctagagaatcagatcataaatggttctcagttgtcctgccctgtgttgccctggcttctctgtgccacctcccaccacccttttccttcgtgtaaagccagtagaaaatattttcattggtggattattatcctctaacctgaaaatgtcaatattagtggtggtaaatggggagaaaacagagtgattacaaagcagattataacaagagatgcaatttggcctgcttttggaaatagtacagtgaggtgagggttggtgtaatcctagtggaagagtctctagtccatggcaggattagcagttcagaggccagatcagaggagcaaagccactgacatatgtttagttgactgttttgagccagtactgtatggtgttctaaacctatgtaataggtgccatgtaagttcttcgttctagtatggtggtagagcctcatgtatatttgaaacctgtgaagaaagatctgtgcagttcctactgtagtgtatagaagaggatgagctgaatctttcagtccatgtcaagtatgttttttctctgaacttagtagtagggtgtgtatttcgtgagtgtactttatttgttatattttataatgcaccttgccatataaattagcagttgcaaaactcatgctttgttttttttttgtttgtttgtttttgttgttgctgttgttttgttttgtttttgagacagggtttctctgtatagccctggttgtcctagaactcactttgtagaccaggctggcctcgaactcagaaatccacctgcctctacctcccaagtgctgggattaaaggtgtgtgcctccactgcccggctgctgtgtttttcttgtttagctaactcccatatagttattgaacttggggactaatatacaaattctagaaatcagactaagccatgatacagaaagctttttttatttgttttggtttttcgagacagggtttctctgtatagccctggctgtcctggaactcactttgtagaccaagctggcctcaaactcagaaatccacctgcctctgcctcccaaatgctaggattaaaggcatgtgccaccactgcccaggaaagctttaatcctgttgctaggaaggagaagcagagggaagtctgtgaggccagcctattctgttgaataagctctaagcctggcacagctactatgggaaatccagccttaaaaaaaaaagacttatgtatatgaagaacttgctgtcaatcatcacctgaaaacagttgtaccaaagaaagtctgactgcattgcattatcacttctctattgaattccattgccctttactaactaccatacttatggattttcaaaaatagaacatacatctcagaaaattcaaagccaccacccacaaacaagagaaaatatggtggttcgcgcctttaatcccagcacttgggaagcagaggcaagcagatttctgatttccaggccagcctgttttacaaagtgagttccaggacagccagggctacaaagaaaccctatctcaaaaaaccaaaaaaaaaccaaaacaaaacaaacaaacaaacaaacaaaaacaaaaagaggaaaacatgcaaagtttttatctctggttctctgttactcccttcagaataattattttcagctccattcatttacgagtttcatattttcagtttttcatgagtttaataacagtacattatatacatttatactaaatgtttattatctattacttgaatgatagatatctgagctgtttccatttcccatgcactgtaaatataaaatcaatgaacatggatgagcagggatatcagaagttttatataggttcttcttggtatatgaccaagaatgttatagctagagcatgtagtaaacatatttttagcttattttataagataagaactgattttcataatagatacaccagtttgcactcctaccagagttcctttttctgtgtacctatgagagcattggtttagtttctatatttatcttagccattctcattggtataagatgaaatctcttaaaaatttttaattttcatccctgagaagtaagtgttgaatgcattttaaaaatgtttctcagccatttgtatttcatctaatcagaattttgtatttagtttaatggtccatctttgaattttttaatttttctttattttatttcatttcttatttttttcttttgttttgtttttagacaggttttctctgtgcagtcctggaactcactatgtagaccaggctggcttcaaactcagaaatccatatgcctctgcctcccaagtgcttggactacaggcatgtgccaccactgcccattttgaaatttctataatttttgagattataatttatatatctccattttctctcactttctttctttcttttttttttttttttttttttttttttttggtttttcgagacagggtttctctttatagccctggctgtcctggaactcactttgtagaccaggctggcctcgaactcagaaatccgcctgcctctgcctcccaagtgctgggattaaaggcgtgcgccaccacgcccggcttctctcactttcttaaccctccaattttcctatgtctaggaactctttgaaatccatggcctctttcaccataactattattgaatgaatatatgtatatacttacatactcaagaccctcttgaagtaggttggtttttctttgtttttgtttgtttgttttgttttttgtttttgtttttggagacagggtttctctgtgtagccttgactgtcctggaactcaccttgtagaccaggctggcctcgaactcagagatccgcctatctctgcctcccaagtgctgggattaaaggtgtgcaccaccacgcccggcaaggttgtttttctttttcttttttttttttttttaattaaaaatttccacagcttaaggaactaaggggacctcgcagtaacagcaagggtgaaaagccagaggccagctaagggactaagcctgtctatcaaaataaaacccaatctttattaatatagaaatatctacttttctagccctctaggaaaacctaaatttcaaatcagaccgaaggccacgtgctggaatgtcctgagaatggaaataacagctgccacctgtgtgctctgggggggggggtgcacatccactggtccggctggagaatgctgattaacgagaagagtcagaatctgtgttctttggacgaattagtctctctggcagccaccgcgctccatcttcatctcgtgaaaaaacacaaaccgagcccctaccccaaattagaactggatctggacccttccattcattagtcagggggtcctagcattttaaagcaccatctacagcacacaactagattatttgttagggttgtttttcttaatgttacattttagaattgatttgtatatcgaaaaactctctattaaatgtatacatgatagagattttttcccaatccaaaggctgttccttcaatttaatgatggtgtccttgctatacataaactttttagttttcttaggtcacatttattacttgtagaactttcctgttaagatcctttcctgtgtcagtgagttcaagtatcccatactttctactctatcagaatcaggatatcaggtcttaagttgcagttctcgttttatttacagttgagtttgtgcagggtcagagttaaggatatagtctcatacatctatatgtttctgtgcagtttgaccaccataatttttttttttgttttttgttgtttttacattttgtgaacaataacatggttgtattagtgtgggtttatatgtgaatcctcagttctattccattaaccagtgtgtttatgtcagtatcatactaattttttttcttaccttagctctatagtataacttgaaatatgggatggtggatacttcctgctagtttattattcaggatgtttttggtacagtaagtcctttgtgtttccacctgaaattctaattttaaggattgaggattacataatcaaaatatagatcaacactgaaaagcattgaaaatgtcagaatcctatagtttcaaatattaagctaggttttaatttaattttatatgtaaaaataaacaagcacctctatctcattagcataaagaaagcagactaaatatttcccatatacaatgtcacagggtatgcattactatttcaaaacggaggaaagggagcattatgaagaaatgctgaatgaaaacaaggctgaaaaacagttaggcaaactccaaactctgcatcttcatactgatgtcaaagtgcttttgcaatcttcaactcatttagctttgttgacagttacgtgctcttctctgttgggctgctttcacagcctgtgagcagctttcctttgcaggtatctcttggttctgtatctttaaaattttgttgtctctatggtaattaaggcttcacagcttcaaaaaacagccatgttaggcctacatgcaatacactccagacacatacctgaccataatggctttgcataggtgcaaagagtgttttcctaagatctttcttttaaccttgattctaaagccagaaccacatagcttgttgtgggatattcacaagggaggactactcagagatggatttgacccaataaaaagtctttactcgccaaccactgactatactgggtcttggggatcccagtgttaccctggacctttcttggaatgaacttttaagcaggaaaaaaaaaacaacaacaaaaaaacactttctgggtcgacatatctcagttaatgaaaacaactagccagaagcagaactacaaaagctaaagtgcacagttggtgcattttgagactttgccaggactatatggatttaatgaataatggctttgttttcattttggcaggtgctgtctacatgctgagttttacacactgaatgttactttcatcaatggagtcagttgtgctatgttttagaggcctaataaggtctggatccttgttatatttcccacttgtcttagtgaacaagtcaaattatagactcattttgctatagtgtaaaatttcagagcttcattgttaatataatctttcttttatctcttgagaagtctaagtctgttcaatttgtagaattatctctgccagaggatttaactattgttttgattcatcaactgaaacttttaatagatgttgattaatgtatctatttagtttggaaagcattagtcaaaccattagtacatataaacagggtagttattatcagaggcccagtaatactgtggttgtcaaaataaattaacccaaaagcagaatagcagtcatcaaaagaagggaaattcctagactaaatgttttatatatagtacaaggtttttgtttgttttaattcctctaacattactttgggctgtctccagtcacactgactttcattggtcaatagatttgacaatctggttagttcccatacttaagtactacatgggtaggctgtctcagcataaccagcacaccttgcttatttttggctaggaataattatgtccattcccaggagtcctttctgtatcatagagtctgattcccatttgtttccagggacaatgggtattgttctatctgaatggaagtagaagaaccagttagttgaacaattataagatcttggtgttggtccagtcctgaggtattggtttatgctgacagagagagtgagacaccaaaattttcctagttatctgtaagtctgagtctcatcagaaaaagtgacaatatatctcagtctatctcaaaggtcttgtcccaatcagctctctgctgttgaatactctgagctacttccaacaattggggcctggtaatatttttatttctcttaacttttataacatttttataatatctatggccaactgggtgacaaaggaaatctgttttgcagctgtctttctcaaaagtaccactgagaattagataaagtctccttagggttttacagaaggggaagtcccttttgttcaggctgtgttgtctggcagtgattctgcggcccagcccacaggcagtttagttcctattctttagtgctgtgtttttatggatcattgattgaaacagtgacagcagtcataaaagagaaaaggggtcgaactttgtattttccttcaaactccgccctgaggaattttccccttccctagggctgcttagagaaggaatgactggtacagagggaattctcacctgaggaaattattttcctcatcctgtatgcattgtgccttgaggacaaggggccctgaatgagtcacttggcttctcccctcctccacactgaaaccaaccctgtgagcaggattcaagcaactaaaagagcaagtgctcctgctccagaagtgggacaaatggaggattttttaaggtttttctgggtgacatgggagggggaggggcaaaaggattcaggtccccaacaggatgggactcaggtcttaagtgagaggtttcttacaccaaagagagccactggtcaatagagggagaaaggactgacaaaaacacatacagacacaaaaaagacaaccaggaagtggctaacacactttcatacacctgagcagacagaaggatctagtgaagttcatatggatcctgcacattgaatcagcatccttgtctgacctcacctgtgtgtccaaccatgccttaaccagacttacctctggaggtaaaagaccagatgactgtctaatttagaaaccttagaggtatcagacacctgtaaggaattagacagcatttgatcaaacagagccctccggacctgtaacatctcaggctctgtacctcctagaagtcccttggccatcgcatccctccaagtgattctgagacacacggtgttttgaggtttggtcgctgagattttggtggaacgcccagaaatgttgtagggctttcaccagagaaaactgcttagacatgagcttaaactgatagaaagtttttattaaccaaccagcaactacttggggaattcaagatcccaatgtagccctgagccttccttaagataagcttttaagcatgaaacccatgtgcagtgccgggtggtgatggtacacacctttaatcccagcacttgggaggcagaggcaggcggatttctgagttcaacgccagcctggtctacaaagtgagttccaggacagccagagctatacagagaaacctgtctcaaagcaaagcaaaacaaaacaaaacaaacaacattgctttagtattggcaggtgctttctacttgctgagttttgcagcatgaatgagcatgaatgatatgatacggtgtcagttgtgctaatgtctggaggcctactaaggtctggagccctgttatatggccaaagagctcaagcacagctgctttttgggcaggaatgtggccccttgctttaattacatctttatcagctttctatttttgatagtttcctttattgcctatgtttggctgttctctatcttactttccaggccatgctgacattgaacctagagatttaccaatctctgccttctgagttctgggattaaaactgtgtaccaccatacctgtacctaaaatgtttttaaattccttttcacaaattacaagtttagctaggcaatgtcttgacctgaagtcaccacgtctttttttttccattgtgctttgggcttttctttaaactttttcctggtgcccttctctcttcaaactagatattttatatttattcttgctcagtttatcccttttcactacaaatctataaatactggccaccagtaactaaataacacaaacaaaatactaggttgttctgaaatgtcctctaccaaagaacattccatttggcatgttccaagctgtttatcaattatacttcaacttagcctgaggaagagttttgcggggcaagggcagaaagcagccacctaaccagaatatcacaagaacagcctctaggatgtgtattaatattcttctctgaaacttcttgatccaggccttcaatgttcaagtcacacttagtatcactgcctgccctgcttctactattctgacctattaggctatacttaaagaattccactgcttttcttatgcaaattaccaaagttcacattcctcaaaataaaataacatggtctggcttatcacagaattacttcagtctgtgatactaacctctgtctcagatagggtttctactactgtgaagaaacaccatgaccacagcaactctaataaaagaagacatttagttgggactggataacagtgatatttctagtccattatcactgtagtggaaagcatggcagcatgcaggtagacatggtgctgaagaggtagctgagagttccacatctagataggtagacagctggtagagagagtgacactgggcctgacttgagcatctgaaacctcaaagcctatacccagtaaaacacatctcccaacaaggctacacctactccaccaaagccacacttcctatgcaactcgatgagcctatatatggggaccattttttattcaaacctatgtgtgtgtgtgtgtgtgtgtatgtgtatatatatgtgtgtgtatgtgtatggatatatatatatatatatatatatcttcaaaaatatgattatgttatttgtgtgtgtgtgtgtatgcttgtgtacttgcatgcctacactatccatgtgaagtcagaggacaattttcagagtttgttctctccttctataggttctttgttttgttttgtttttgtttgtttgtttgttttttgagactgggtttctctgtatagccctggctatcctggaactcactctgtagaccaggctggccttaaactcagaaatccacctgcctctgtttcccaagtgctgggaataaaggtgtgtgccaccaccacccggcccttctataggttcttgagactgcatattaacatattgagccgtctttctggggagagagaaagagaagaaggagatgagagagagagaccaagagagatcttattttatatgcaaattatctatatttgttcaacacattatgatagtatctttgcccaacagttttcttagcagatttgttagcattataccttcttaaatagtcattttctttttgtgttgataaactttaattttctattcagtagtggtggctggtataggaagctgaatgttcacacctttaaataaagcagcaaccaaagagagcaaactggaaactgcacaggtttgtttgtttgtttgtttaaaaaaaaaactcaacaccctctctttgtgttttactttttccaggaaggctacaccgcttaaacttcactaaatagaaccatcacctgggaaccaactattcaaataccagaatatgtggggaacatttctcacttaaaccatcacagatactctctagccctgcaagcctgtcaagcaaggtccagagttcttatatactccagagaagtaccataacacttgctgtgccattgataaaacagactgcacacagactgctgacagtcatagggctgggaaaatgacatctgctctagtttatcttggtgccggggagaaaggtacatagcactccaggggagataattgtttacccataagacaaacttaatctcattttaaaaaaggtgtgtggggtagtgggtattttgttttgttgttgttgttatttttttccagggacagggtttctctgtgtagcactggctaacctggaactcactctgtagaccaatatgttctggaactcagagatccataaaagcatccgcctcttagtactgagattaaaggcatgagatgccaatgcctggctcaaaagaagtttgaagatttttctgtttgcttgtttgtttgtttttgacatagagtttctctgtataacagccatggctttcctgaaactcactctgtagatcagactagactcaaacttaaaaagatccatcatacctgacttaaaaaataattaaaaaaaatactttaaagggtcttgttatgaagcacttgctgacctggaacacactacataggccaggctatgctttaagtcacaaagatcacactctgttctcagcacctaggattaacggcaagtactactacaccgagcctcaaagttaaatctttatcatatgcattatttagcattcatattttctgtaaactgctgcctaggctttaaaacctttcagaagttcactagtctagcatttggcttttaggtagcattttcctgaggcattcaaggctcagtacaattctcaccacatttacctatgaatgaatctagaaaagcaaattgtctgctttagccagtctttttttttttttttcctggagcctctcttagatttttcccaagacattgtcccccatatgtcatttttgaccatgttttcatatatctcaaagagaagagaaatgcatactctctcacttctaacttactttctccatcttcactgattttttttttttgctttatgtacaagggaagaaaaaaataggatgtggaaaaacagaaagtctaaagtataaggaaaatggccatagacattattttggagaaaactaatttccctttgcaagtggacatcagttgtaaatagctagttggtgggagccactatgcatttctctgtctaagcactgggcacccatctggcttgaacctgtgtagtcttgtgcatatgttaaccccagctcaggctaggccctatgcccaggagtaggtggaaaacacaaaacataattttggtacttttatggatgattggtcttatattgttttatttgtacattttttgtcttattggtctttgcttggatattttggttatgatcttttttccatttttttatgattttacttgtgttttagagagagagatgaaaggcatgaagtaagggagatagggagaatctgggaagagttgggggaggggaatatatgatcagaatatattgttaggaactaatttctttcaattaagaaaaaaaaaatttccggggtagtggttcagtgtataaaaatagtgactgatttttcagagaacccaggttcactttacagtacccacatggaaggtcacaattgtccagttctagagtgtctgacaccctcgtgtagcctctagggacaggaggcatacccctggtgcacaggcaaaaacttataaagtaataaaataaactgtagtgtgtgtgtgtgtatgtgtgtgtgttagagagagagagagagagagggagagagagagagagacaaagagacacagagagacacacacagagagaaagacaccccctcccccagaaaatgttatctggatagaaacaccttttgatctaacaggaagatcctgcaggtcatcaaactgccccctaggaaggagacaaaagagctccaatcttaggatccttaaagttccaaacaagtgttaaagaaaaataggtcatgaatttgaaagagagtaggaagtacatgggaggtcttggaataaggaaatggaaggctatatggtaattttctattataatctcaaaaagaacaaaacaaaaccaaaaaaaaaaaaaaaaaccaaaagaaatgcctcactgtatttttgggaatctttcaaagctgtaaccacagcgacccctatcatccaataaacctgtggctgaaattgtgtgagagtgttgctatcaaaagtaagctttaaaaaaaaaagttttgaaaaagcagcgtagtccatgaaaaaaaaaaatacagcaagatttttttaaaaaaacatttcttttaaagccaaagtaatgtaaaagtgatgggggtcggggtcacacagcatcccaatttcttctttctttttgtttttgggttacagaatttgaggataaagcatcttctgacaattgtgctacccttcaggaatagaatgatctctcccattgttgaatgattctttctaaaagtgtgggagccatgcaggaatttggcttattgtgagacagctgatgttttctacttcatcttcatataaaatcattctgcctttgtaatattacgagccacgtggtaagaatttacctgtaatcttcctaaatctaacgaactcagttcaaatattatggaattatattgtttgcttgttttccttctttgttttttttttctttttctgagacaaggtttctctgtgtaaaagtcctgactgtcctggaactcatgttgtagaccagactggagtcaaacttacatagataaacctgcctcacttgggcgagtgattgctgggattaaaggtgtaatttaccactgcctgtcttgttttgttttaagatagtctaactctgttgtccagtctaaactggaaaatactgcttacttcatgggaggcaacgcttgattcatggcaatttttctgcctcagattttctgggataaaaggaacaaagcaccatgtttttagctcaagatggttgcattagtttgcattcttatcagcatggagtaagtttttaagtccgttgtctctgtaatactcaagtacattaattttatattcaccagggcctttcagggttagcaaatctgtaatgctaggactaggaagcagagtagtagttttgatgcagcctagtctacatagcaaattctaggacagtgagaaggacacaatgagactgtctaagaaacaaaaaacaacaggaaaggttttattatgaggcccaggcttgcaaagtgccctctctgtctgatttctagcaccacataattcctgcaaggtaaaattccaacccaaccatgacacatcctgtttcaaaatctccccatcttgggaaaacaaaacaaccccctccttcactaccaccccaacgccctctaccctgccaaaaaaaaaaaaaaaaaaaaaaaaaaaaaaaaaaaaaaaaagaacaaaatcaggcatggtgatcccttgctgtaatgagggtagaaggcttattggcttattctgagttttaagccagttagtgcaacaaaggaatttccaagcacacctggggtagattaagaaccagcctcagaaaagcaacaacaaaatacacaccctgcagcgctgagctacactccaccattcctagccctagtctattgtcttttcatttttccataagtagtctgtccttgtgattttcatttgcatttccatggtgactgacaatagtatctaattgtttagttctatgtaaatagatttcttcagctgttttcgaaagttcaggttttggttacatttagaactgaatgtatcttcattgaagttgaatttaggatgtttgcgaactggatgctagctcagtgcggggggaagggaagtagagaacttccaactttgttagaatacctcattaacagttcttgcaggccctcattaagctatgctaaacccatgtaaatttagcttccttagttttctccttgccattttgttttcctaatcttcaaataattgcatattgaagttactaccacaataatacttttactaggcagacaggaaattaataggtcaaaagtaactgaaataaattcttatatatgtatccacaatctacaaaatgtttttgtttttgtttttagatattgttacaaattgaacctggccttgagtatgcaaaaatactgctttcttagaataagtttcctaagagctggaattactggatggcatttctatgaggtcatatatttgttagtaaatagtgtctacttttcaccccccaggcataacaacatttaggaagccctgtctctaaaaccaacaacaacaaaagaagcagatacataagtttcataactgaatgttcttcctattaaaatttaatcacaccatgatctggaggaaatagttttctcccagtcatatgttctaacacagagaaagaaaatacaagtaatactacattaatgtagaatgtagaattaggaatcaggataacttttttttctgtacagaattttaagtatctgacaatttggctgggcttcatgtttgattgtgtgtgtgtgtgtgtgtgtgtgtgtgtgtgtgatacactatgtaacatgatatagcctagaaaccagtcttcctcatattggagatcaaaccttttttcctctcccacataataaaaatctgtgtgatgcttgcaatcacttgggagcaatttttttaaaaaattaaatgtatttagtaataggcaattatatccattattccagattgacagtgatttttttttttttaatacacgctcaaatttccgcagtaggaatgctcaagcattccttttggtagctgccttttggcaggacattccggtcagagggacagagacccctgcattgcggcaaaaatgtgcgcatgtgcagccattgcctgggacgcatgcgtagggagccgcgcgacaaacctgagccattgcggcaagactagcgcagagaggagagggagccggagatgccagacgcttggttctgaggagtgatttgcaacgcaatggagcgaggaaggtcagctgggcttgtggattctagtagtgaaagtgcatcctatttgaccaaaacattctagatttgggcttattaagatttttgacaacccagatacctttatttttgagaattggtgagcaatcctttggagccggcagacggactccttgggtgtgttagtgcggcacctgcgtgtaacgcgttgcctttattatggtggtctgaggttgtgactgggatcctggatgcaggagctgtgttgccgcagcgtgggggctccaggatgcgggacctcttttgtcgcggcctctggactcctggaagtcagagctgtgttgccgcgacttgtaggtccagagattttggaactattaactgtgtggcctgtggcctccagaatgccggagctctgttggttctgggggtgggtgtggatagaagttctgttgccgctgcaggaacctgtagagtccgggattttgtaactgttactgtgcggcctgtgggctccaggatgcaggagctctgttgccgcagcctgtgggctacggggctgggtggacactcttgtccaaggctgtggctctgttgatgcagccagtgggctacagggcgtgggaactctgctgccgcagtgtcgcagtctgttttctccgcggtgtgggggtgggggtggggagggagctctgttgccgcagcagcctatgtgctacagggcatgagaaatgggcggtcgcagcttgtgtggtctgggggatgggagcaccttcaggggtctggggaactggagctgtgtggcggtggcctgagggctgggagcttggttgccatggcttgtgtgttcagggtgggggctactggagtgctgttgccgcggcctgcgggctatgggggtggtagctccattgccacagcctgtgagcctagggtagagggagcggtagctctgtcgcctcttagttcatgtttgggggagctctgctgttgtggcctttaggctgagggtgcgcgcagggtgtgggggatgggggcattctgggagctctgttgctgcttcatgtggcttcaaggatgtcagagctgtgtagtggtggtatggtagggtggaaggtgagcgctagtgggtgattttctctgagatctctataactacttctcaagatcatgtggttgtgtggcaaaaagatacttgcaagtcagagaagtgattgtgtgtccaggttggttgcaggtggccagagtgcttctggtttggggccttggaactctgacccatggatggaggtaattaccgtacaaagtctggtactgaggccgtagggtgtcatttttagccctgcagtccagtggcagtctgcttctgggtgcttccagggtggggtctactgaggtagataaacggaatgtaccaatattggtggaggggggagttgttgagaagagaacctgtgtagaatggccagacctcaccttaaggatttttcttgcagtcgtcccttctaactgggttgtgtattttgttcttgttgtttccttttgtagaattgtttcccatttacaagatagggatgcaagtctcagtgttccattttcttgttgtgtcactgtcaaccacccctcacagtgggggttagtgtatgaagtctatgcaatacttgcttttacccactcattgagtagaggtaataagacaatgtcttttattttttcatggcatcctgaattttatcaaagtcatcttggtattatcaaggggtcgtgtcgcatgtcaaacgccattgtgaggatctgtaaagatggccgctgctgcagaggtgctgaagtgcgcaggcgcagcatggcgtatacagggcagtagacccctccccattatgctacaaacctaaggagataacagcacttgtcatttctgcggtgttggaatttcagccacaccctttcttaaggccctggagaactgagcctattgatcactggttctctccctacaggcacctgatgcagtagaggtgacacccacctctccctgcattgacaaaagaagggacttctgcagaggaattgtgcagtattggcatcaaggggatgactaccatttccttaacctggtgctacgatagctgagtatctttacccctcctttcctgcagtgtcacagtagggaacggggagaaaaaggagacttgtttgtgcaggtttcttcctcttatcttccaagacctttgataatggaaggtggggggaagcggggagttgaatttttccatgaattctggtatttggaagatggggtagggggagaaggaatctagaggttatcggtgtgtatggcctgtccctgtattcttagttttttagtagtataataggtgtgagaatttagaataatttagccaggtcaggtcaggacctattattggtgatggtgaagatagcattacctaccaggtaggaaatttatatttatattttaatgccgacttaaaaaaaattaaacactctgtagcagctaaaaatataagctgtacttaaagagaagacagaaatttaaaaaccacgattgtacatgatttaagactggatagatttattgataaatgactcttttttttcaatttttgaaatagaaactactctaaatttgaaagaaaaataagcaaaataactgcatttacatttctttatcaaatacacttaaatttaaaacaggtttctgacataaatcaacttagtgtcagacatgatatgtatcccactgtcaatggagctggtgatccaccccaccttctcccttcagtgcttgaaaccacaggtgtgactcctgtgtttcatactttcaatattttttcatgatttttttatgtgcttgctttttttaaaaaaatcttgttttcttcacatttatgggtaggtagtatttatggttgtcatatgtggtaatcttaaacaatgctaaattttagaacatagactttgttttagaagtttgtctttctgacatgacagtatgatcttgtagccaaggttaaccttaaacttgtaatcttcacactgcaattgccagacttcaaaaacatatctttaaaatattgtatataatataatttagcctttagactctagtaacatggggtttcaactaatcttttggctcagctactgttaatgactattataaaactgcttattatggcccactatattttcttagttgaatcagatctctttgatgaggctttctccttttaaaggcctctgaactttctatatctttgccttaagtaatgatttggtgttgtgattacttttgttacccttttaaggaagggtctaactgtaactcaaaatgcagtctcaagagacagttgactattgtgattattgctgcaccagatactgagttggaaaattctgggtgtcttttcttcaatttagatgaacaaatcttaattaagggaactttattgttattaaaagtgttattttacttgttttgttcacagaactttatgttaaaatgactgaatttagtcacttttttcattctactaagtatttccatctagatctattttatttattcctccctcttttcatgaatgtatcttcactttaaaaactcacacttaaaatgtagcttttgaagttaatttgctatatttattactatacttatgttacttgtctaaataatggtaagagaatttataagtaattttttgttttaaggcaatattttgataatatagctgtggagcccaagctagtcttgaaataaatcatcccatttcagtttaccaagtcctatgattttacagggcagatttgctgaaagacatttataagtgtgtacgtgcacacacacacacacacacacacacacacaccacataaggacagttaggttattttttaagaacaggttaagattctataaacaaaacaactgttaactggtcaggtgcttaatcaatctagttttatagataggtagaatttagtgaattggcatttggattctgctttcgacattctttcatgacttgtcaaagaccttacatttgtctttttttcatgtgtttttctaatttcagtattatgaatggtttctgcagttcctaacatggccaccctgaggcttctacttattttcaatttgacagaacggccattttgtgaggtgttcccagatcttaacatggaagtgcattttcccagcctgtttatagcatttccttaagtgaccctgttatttctttgtaaatcctgaagacagctacatgtacatatgaatattttaattaataattttccaatttaattttttatgctttgttagtctggtttataaatggattataatctaaaaatattttctcaagtagtttggagtgatcttggttttttgtttgtacagaggactggcacatattgtatatgtatatatggattatgtgtgtgttatatctatatacatattttttgagatttataattggaaataatatattttacttcattttccaatcttaatccagatttttctcatgtaatgttctcccctaaattatgtttaaatctcaggtcctaatatcttttaaatgtttattttacatacgtatgctttatctacatgtatgcctggatgtcagaggaaagcatcagattgcaatattgataggtacctgtgagccaccacatgattcctgggaattgaactcaggacctctggaagaacagacagtgctcgtaattgctgagccatctcaccatctccagattctaatatatttttaattataaaatactctaatgttttaattgtatcttattttttttatcacaacacgggcttcctatgttagacctggctggcttagaacttatatatgtagaacagactgctttagaacttagagaaatctgtcctttttgcctttaagtattggaaataaaggctcactttgtcataattttatctttttttgaattagattatgaataccttttaacattcactatgcaaatgacaaagattctaagtggagcctttattttttccttcaaactttcattttgtttttagtgtgtgtgtttttttttttttttttttttttgtggtaaagggagggagcatgcttgtatggcagatacagaagtaaacatagttttgtggagcaggttctctctagatgttcaagggtccagggatcaggttgtctagtttgtcttcacagctggaaatgctttacttactgaaccattttatcaatctcatatttctgtttcagggtaaggattcatttagcctagactgacccccaaatttgcttttttttttttttttttggtttttgagacagggtgtctctgtatccttggctgtcttggaactaactctgtagaccaggctggccttgagctgagagtatccttaaacttttaatttagggctgttgtgatcataaaccctgtcttcatctcattactgctgagattaaatgtatgtactacaatctcttatttacacagagctgggaatggagcccagggtttcctgattccaaggcaagagctcttaagccctcataatgcatttaaatatttttttaataaattaattcattttttttctttcagggatcgcttacacttgagaagaactactgaacagcacgtgcccgaggtcgaggtccaggtcaaacgtcgaaggacagcctcactgagcaaccaagagtatgtgaattctgagttaagaaccaaataacagaaaagtgtcatacaaaaaaagagattgcaatgatattgattgaattcctaatatagaagatgtaacaaaataattaaatctgtaattgaattgtttgaacagaagtcagcttttaccatttcaaccattcctggttgaaatgatacctgatcccaccttaggagggagtgctggaattaacagcacacaccaaaacacctggcttcttattaaggtattcagtagaacatgtgactttttcctgacatttcaattataggagtgttgctaccttcatctctcccatatttttgtggtgattgaattaatcttagagcatcatacaatttatagaagtattctatttttatttttgcatgcataagtgtttttaccattagaattatatattcacagtatgaattcctaagttatggtatttattttgcattcttataaaattttctgcattggtgtgagacattaatgtacacatttggtccttccttataatgaaacttattagttttgagatggatagcctatgctaaccttgctatttttttaaatcacaaaccagagtatccccttgactcttggaccttctccacatcccaagtgctggtattgcttgtgtatactaccatgcctggctatatatttagattcattgaatagtatatcttagctaaaattttaaaaatattttcactaattctttgaatatacacatgtacacacataaatgaatcttggtctttaacttaaacatatttaaaatatactgattactgatgaagaaaactctcaatttaattagtctcaaaactattatcatctcattctcctttttttcccctagagataatcacaaattgttctcatttcagggctttttcatggccttcacatttgtgtttttgaggaggtataagagaagaaatgcagtttgagttctcagtgtacctttgctacctttactttggtacatctgtatattgactttatagaatgcagagtctgagtgctgtaacaataggtacttctttttttgttgtttatttgtctttgttttttagttttcgaggcagggtttctctgtgtagcactggcactggccgtcctgaaactcagagatctacctgcctctgcctcccacctgcagggattaaaggtgtgggccaccactggctgactgtttatttcttatgagactacttgacatttgttttggcatttgggagcagatactgcagatatttattactgtttctgcagatattatactgtttctgtagataatatactgcagatattattgctgtttcatatcctttatactaaaggactttttttccccaaaattgtagacaataggcaacacagcagtaaaatattttaattaaatcacatatataatacatacacacatatatatatataatacacacacacacacacacacacacacacatatatatccttccaaagtgatctgaaaaatacagtgcaattaaaagacatgattaaaatgatttttttgagatagggtctcactatgtagctctgtctgttctggatcttactatatagaccaggctggacccaaaatcactgatagcctcctgcctctaggatacaagatgagtaccactatacctggctaagaatgctttcttaaaataggagaaaataagaaaatattgactcataaaagttgtttatagtgtgtaaactttcaacaactatcttgcaaatggggaaggatgtcttgggtttttctgttttgaggagtggtctattagatgggccttggactggaaattacagcacttttaccttaggttcttcagaatcataggttatgtgctaatagaatataaatctcttggtatttgtttgttcatttcttctgattttatttcctgtttctcagaggttttaccaggtatctctggtggtcttacaattcactctgtacaccagattgacttcaaatttatggcaatccaattgtcactgccttctgagtacttacattatagttatgtgacaggaaatgcctcttgtgttttgctaattttttttctatagagcaataatatacatgactgaataaaattctacatttattgcaatgcacttagcttttcttaggtgtcaaatatatgtatatttttaaagatttatttattattatatataagtacactgtgactgacttcatacgtaccagaagagggcatgtactcactgataagtggatattagcccagaaacttagatataagatacaatttgcaaaacacatgaaactcaagaagaacaaagaccaaagtgtggacactttgccccttcttagaaatgggaacaaaacacccatggaaggagttacagagacaaaatttggagctgtgacgaaaggatggaccatctagtgattgccatatccagggatccatcccataatcagcttccaaacactgacaccattgcatacactagcaagattttgctgaaaggacccagatatagctgtctcttgtgagactatgccggggcctagcaaacacagaagtggatgctcacagtcagctataggatggaacacattgcccccaatggaggagctagagaaagtacccaaggagctaaaggggtctgcaaccctataggtggaacaataatatgaacgaaccagtaccctggagctcttgtctctagctgcatatgtatcaaaagatggcctagtcagccatcactggaaagagaggccctttggagttgaaactttatatgccccagtacaggggaacgccagggccaaaaagggggagtgggtgggtggagaagtgggtgggggagcatgtgggggacttttggaatagcattggaaatgtaaacgaggaaaatatctaattaaaaaaaaaagatctcatttcgggtggttgtgagccaccatgtggttgctgggatttgaactcaggaccttcaaaagagcagttagtgctcttacccactgagccatctcgccagcccatgggcatatatttttgttaaggtttatttgtatcgtatatgtcagcacaacatatgtacctagtatccaaggccagaagaggacatttgggtctcctgggagtggagttaacattttccagaaggttttgaactaccatgtggatattaggaattgtacattcttcctaggagcaacaattgttaaaccatctgtctagcccatcactattttagtttaatctgtgtgcttgtgattgtgggtgtggtatgtggttgtgggtgtgtgcttgtatgtgtatgcagacactttgaaaaatggttattgaactggattgatggctcagtggttaagagcactgactgttctttcaaggaaaggtccagcgttcaattcacagcaaccacacggtagctcacagcaatctgtaacaggaggtgctgccctcttctcttgtatcttaagagtttctacatgaggactcttggctttttagttattaggatacatccccatactgaacaaatatctcatagtttatccatttttgttggcagaaatccctgtttaattctttagtgttatgttcgtacctaaatgacaatattttaaactatgttagactttttaaaggaggctcttttagagtaaaggtgtttataatttcctatttattgctatctacaaagagatgccttctgtcatttaaaaatattgtactctttttgtaggtgtcacttgtacccacgacgttctcagcaacagcaagttcctgtggtggatttccaggcagaactaagacaggcattcttagctgagacaccaagaggtggttaaagcagtattgcaacttcaaggtggtggaattcaaggaaaacaggttagaattaattccaaaatgaataaaagtaaaaagaaagcataaagtatctaggatttaattgataaaactactttttaaaaaatgaatactatatataatattatattatatatataatatatatatataatatatataatataatatatattataatataatatatatatatatatatatatatatatattaatatcctagaatgaggcacacagattttctaaaatgcacatattaaataacactgaaaccagtataactaccatttaatgtatattccctgacatgttgtgtttccatatcctactttggaatgcattaaggaaattttattttctttttcattgattattttttttctactttacaaaaaatacactcatttattagttaatttatagtgccccctcttgtgagattttcctgttaatattttatatagtattgtattagcttttattattttcaagaaagaattatgtttatgaatatattgaattattttaatcatgaatcagtaggcatggaattctacagaaagtatttcaccataattatttctttgaatcagcatatcatgtaataaaagtatcatctataatgttattacaatacttactgtagatttagatttactttatttagattctattttacagtgtagtgctttggttttcttttaagtcagttaatttatttaatttataaatattatgtgtctatggtgctttatacctgtatgtctgtcctccatgggcatacagtactcacagagtacaaggctttcttggacatggtgtgaaataatgttaacagatgtcttatttataaaggttgtgctggaggatggtcttgtcaggcatcagttgtcaggcatcaatgggaagagaggtccttggtcctatgaaggcttgattgataccccagtgtaggggaattgagggcacagaggcgggagtggatgggtgggtcaagggacattctcataaaagcacagggaggtggagatgggatagaatgtttccgggaggtggggaaatgggaaaagggatagcacttggcatgtaaataaaaaagtgtaaagaggggaaaaaagaaacataagtatagttaagaggaaacagaaacaagcaaacaaataaataaatactgtgttgcagctataggtatcatttgtgtccaaggtgttctcagcagcagcagagaatttatgtagtgagttataaactactctaaaatgagactctgtttcacactttggccaagaaagcctggatttcttatctttctgctctatgacttaactcttatatgtctgtactactatatgtgtatacatactagagttattttttacaagtttaatgcatttattcaggcaagatctcattatatgatcttggctgacctgtaatttaatttaaggaggcagcctcataagccaacccaatgcatgttggactgttgtttggctaagttttgtgcaggcaaccatatgtgcttactgtgatagttcataggtataataatcttacaagatcatgaagacactatttcccagaagtgcactgatgtctggttcataatttttctacccattctgtgatggtttcttagacttgcgtggtagtgatgtgatataatttatgtctgagccctcctcttcacttattttctgcactttgttcaattgcaagtctataaagcaccattcattgcagagagaatcttctgatatgaggtgagacatgaactaatatatgggtataaagtatgtagagggcagtcattttatgctataccagtttaacaatagttgtagcttcccctatagtgctgtattctcagctgtattgcatgcattaactttgcctattttattaatttaaaaataaacattaagtatttttacaggaatctacggcggcctaagaaggtatcacaattccctggaactagaggtgtagacagtgttttaagagagcttatgttttaggagaactgaactagggtcctgtgcaaaagcatagtagcatctcataaacagagccaattatcttcctgttttcagtttttaaaactatcaattaaggtaggcatggtggctcttgcctttaatttcaccaatcaggaggaaaaggcaagtcgacctatgtaagttccaggccagtcagcctaaattaggagtttcaggctagtcagtgctatgtagagactctgtgtcagaaaagaattagccaattaaaaatatacaactaaattagacacctgttgactactccaataataaccatgaaatccttgtaccaatggtcctatcctaacagggttcacagcagaataggaatgaattttcttcagcatcctgtatcgcaccttttgacactgaaagctagccagcatttaggaagcttctggcacaatccagttggatatgtctgctctctgcaaataaattatgtagttatcttaagcgatgggtgcttgttatcaggttttggttggaaatgtaaaacaattacatcagtgtatgttatactgaggaggagatagtctgcaccacactgtaccaactcaagggaggtaattcacacctgacagtgggtgctttgtttgatacgttatgggtttggaaaggaacatcttcaaacccatgtaactaaaaatgaatgttttatttcacatacacacacacgtatatatatatatatatatatatatatatgtacttggaaagtttgattgatcagatttctgcattgatagaaagttgtaagccatcatttggatgcaaggaccagaaataggtcttttaagactattgaaccatcacttcagaccatttattttattgatttcagttctctggaggtctttatatattctagacagtttgcttctgtcggatatgacaagcaaaggtattttgcaattctgagagctctctatgtattctacgatgtgtccttttctgtacagaagctatttagttttgtgagtttgcagtattgattgttggatttgttttctgcattaccagagttttattattctttgcagtttggtctatttccctgtgaatttcattttctttatagctgaaaaagaaattgccagcaattagcattgttaaacaaatgagtgtagggtacagtgtacacatatgtcgtagagtggaagagcaggatcagtaaggtttatatacttgaatacagatttaaaaggcaatacaatcctgtttggcatgttgtctatagtttgctctctgacagtactaaataacccttcccttcacattgtttctgttgttttctcttagcaattgtgacaggaacataatgaaatgtaaaatggtttgaattttcatattcctgattgatacccccacatttttatttattacgtatatattatatattatatatgtatgtgttctgcctgcatgtatgcctacaggccagaggagggcacaagatctcatagatggttgagagctaccatgtgattgctgggaattgaactcgggacctctagaagaacagccagtgctattaacttctgagccattttgccaggcctgctaaacacttttaaagatttttaaagatatttctgtttcttttgagaactctattaatatctaaagcctattaataactgggttctctctttttaaatgtatatgagtgtttttacctgcatgtttgtatacatactatatgcatttagtgcctgtgaattacccatgctgaataaggatgaagatagtagtggttcttatttattggggttgctttgagatttttctctatttaggatagctttcattgccaaattgttatagccattgttttgtgaaaccttgttccttaaaatacacacacacacacacacacacacacacacatatatatatgaggtgatgttgaattttctaaatattttgagatggtcatgtgacttgtctatctctacatatgagatttatagatttattgatatgtgtatgttgaaccaaacctatagctttatgataaatccagcttgattgcattggattatgtttttgatgtgtgtttttatttgatttacaggtatatggttcacatgtttattatggattttggtctatccattttttatttgtgtgtctatacctggctttgatgttagtgtaataataacttcataggaggggttcaaattgtaacttgtatttttttgctaatttgagtatactgtcacacctgcccaattgttatttatattggcttctaggcaccctaattcaggcattatatttgggagcaggtactttccaagttgagccattctaacccttatattctgcggttaacactctctctctctctctctctctctctctctctctctctctctctctatatatatatatatatatatatatatatatctttatataatagctatatttttaaacgtatctaatattactcttaaccagggattctttgtatagccctggctctcttagaatagaattttcttggaagactaggctcgtcttaaatttaggtcagtctgcctcctgagtactaggagtaaagtgtgtgccacctctgtccaggtaataattttaatacattttggaatagagacattcatttacacacacatcattattcatgagtttgacgtcacttggattaacattggcagttctaaacattgtggctgattaatgatattaaatggtaagatcatgctgagcttgatgatactttccattaatgccagcacaaagaaggcagaggcagtcagatccctgaagccagctacatttacttctttgagtttcagaactgccagggctatctcaaaaaacaaaacgccaaggaaagatgtcacattgaaggacagcttgctagcctttgtttgtgaaatatgtctcaaaacagacttgttagttgagttactagtgatacttgaagataagaaagaaaaggctataggaagaattaaagtattcatcatagactgagagctacttaaacttcagaataagaaaagcagtcttgggagtttgacatagctgggcatatagtaccaaatgcctttgatcatagcgattcagtgacaggcagatttctttttcttgtttgtttgtttatttcaagacaggatttctctatgtaaccttggctgccttggaacttgctctgtagaccaggatagtgttgaactcatagagatcctttcacctctgcctcctgagtgttgagattaaaggcatttgccaccatttcctggcaaaatgtaacagattttaaattttatacatacatacctttaatgtgaagatggtcagtataagtgttttccttccaagaaagagcatctaattttataattagataattttctacatacagatagtctacaaattccccaaaatataatatgaagcattattatcttaaacatttgttttgatacatttaactaactggcagcttttctgtttgttttgtttggagatatccagatgttttcctatgtactccaggctagcattgaattctaggcattgttctatcctgccttacctctcccaagttctcataggcatttaaccatataagtttttgttgtggtggttatggttttcttttttgttgttgttgttttttgtttttgtttttttgttttttgtttttgttggggagggaaaaaattttatgctttaacgtgcaattagcctttaagaacgggctatattcttaggcctttattgtattttacatttatttttttaatacttaagttttcaagctttctgtaagactgttcctgccataaagccactgaattcttcctcagcattatgtatacttttactgtaactatatgtcagttttcagcttttgtagtttgtgctcttcaatgacacactcattgatttgtggaggaaggttattcatcgtgactttaagaggggccaaaagtagagatagtgataaattttgggaactgaaaaatgtgggtgttttatatatatattatttaaaatattctaatattataaagataaatatttaatgtgaagatggccagtataagtgttctccttccaagaaagaggatctaattttataagcaattgtataaaaacctggtaataatgttttgagatgtctcagtgggttctgtagaagactccctttctagcattcacatggaggctcataactagctataacttaaattctaagggatttgatacctttttttaaaaccttgagaacaaagaacatacataatacaaggataagtgtgcagacaaaacacataaaattataggtgacatctgtgaatcactgctgagtggctagggaggtggatttctcaaacttaaaacatattctctgatcacatgttcgtcacaaaggaaggtagcacttctatttgacctataaatacacccagaaacaaacccagaaaccttaccaatactggtggcaatgggtttcagagatctgttgggtagaagtagtgctaagaaggaggactggaactgttcattgttggacgcgcaatcagtctctaatatactgtttgaaaatggttgatttttaagccatggattgaggtagaaatgtgttttcctctgcaggacccatcctctgtctgtgaaactttggtcaagcttacattgtttgttaatagcctgcatcgaacctttatttatatcccttccccgagtattaaggatcttgaaattttagtgttgacaacggctattgtggaacagcaatcatggtaagttgtacatttaattaagcgaagggttggatagctaatttaatgaccccacatcatagtttctcaatgtatggggttttttatttcggtaaaaaatttgaaataaggatttatctttatagaaggatgcttattcttctgtttagcaatcaagagatggcctatgcttatcctgtatagggtggttaaaagctttggaaagagtaccaaggaatgcatacattatgtaatttttattcaacgactaaatcttttaagggatcaacttgtagatagatgactcttagatcaaatcgcatatcacaaccacagactattgggaaagaacagctttcaatcaacagaaatacagttggatgaagagagattgtcctatagattactgtgattctgagagtcaagggcacagatctataaaggagaagatgctactctcagatttaagtagtatgactcatgcctaaaaccagcattttggtgttggaggcatgaagaataggggctcatggtcctcatgtgtgtatgaagtccagtatcagtcttggaaccctgatcctatttaattttctttaataatagtgatgtgggtctgatggatctgggtgccttttggggtgccagtggatcattgtacattcattgggctagtattcatcgttatttgttgaggtaattttttatgtttacaaaataattcacaggacaaggtgctctgttagaagctcatgtaatcttctagaaggaaagcttgaagttgaatgaaatagcaactataccaagtaactaggttgaaatgttttcagtttaggagtaaatcccattaatctttctagataagataatactttaaggttctgagaagtgtcgatatatttatagtgatcctaattctattttatatttcagtaattggaaaacatttggaaaaaaaactattgaagaaacatggttataaatgtaggcaatgaataagctaatgttagaaaactggactacagattacacttaacattgatgttcccttctaattggcagactgtgggtaagagtagcaagatgctgcagcacattgactataggatgagatgtatcctgcaagatgggagaatcttcattggcaccttcaaggcttttgacaagcatatgaatttgatcctctgtgattgtgatgagttcaggaagatcaagtaagtctgtttggggtcatgggtgtgggaggtaggaaggagatggagggaagttttgagctaaagcaatatacctcagagtgactgtagtgaatataggcactataatgtgtcagttttgctcttacctattagccctttctcaggattctgtcaaatccttacattgcatcatagccattgcatgcatatcatgctggcaaaaatatatctgatgtcaatattatttggttgtagtttctaatagatttatcattttattataattgaggcttaaattatgcctacttaaataggtcgtgtcatgtaatctgtatctaaattgtgaaaaataatctaattttgcatatttctataatattgacgcattcacaggaaactaattttactatttttacatgactaagtcctcatagtaaacaggcaaataaactgttgcttgggaaatgtttcattgaattttaaattaaacttttgataagaattacaaaatgatttcactaatatttatttacttctgatttataggccaaagaatgcaaaacagccagaacgtgaagaaaaacgggttttgggtctggtcttgctacgtggggagaacttggtttcaatgactgtggagggcccacctcctaaagatgtaaggaagatgcagaacaggacatgcatgtttttgactttcatttttaatttatatacaaaaggttgatctataatgtggaggacattttgttattttaatgtatacagtagaagaacactaaaatatacctagtacttaataccagtacatctgtagccttaggaattaaggatttatttttgcttccacctatgcacctatgtactggatactccctaagttatggtaaggaattgacttctttttattccttagggttactctgttttcaaaaggttttgtgggacaactgtcaataattatcaaacagataatatgttttgtccaatcactggaaaacctggacacccactcacatttgcatatatctttatggaaaatcactaaagtttagccttgaacttgtatactttactttttctagtgtagtaagaaagggcatgcattttgatttgaccaaagcaatgcttgtactctgatagcaacagtccacttttactagaaggtaaagtgaataaaatatctataaatgaatttttttttgagaagaagttgttcagggtttaccctgtttatgtttatgcaagattatacagtctcattgtatatattcaaaatctgaagggttcagaagagtatttgttgtattacaccatcactttcatttgtatataaagtgattggagataggtgttttgtaaaatttagttacagaatttgtctttcaataaatgaaattgtgaacaaactcaacatgctatgtaagctatacatttttgttttagactggcattgctcgtgtgcctcttgctggcgctgcaggtggccctggggttggaagagcagctggcagaggagtgccagcaggtgtacctattccccaggctcctgctggattagcaggccctgtcagaggagttggaggcccatcccagcaggtaggaatcacaaaaatgttttctattaatgagaaaatataagtagagcctgagaatgatgaaatgcggaagcatgaagatgtgtctatactatttaagttgtatatgttctaaaaagatctgatactcaactgtaaatggaagggacttatagttgctagcttaaaaaaaaaaaaactttgattttatgtcattaaagattcagttatatatgccagaatgaagaaaatcacaagcttagaaaatgttaatatgctaagatttaaaaacatgagactaaagctagatgtagtagtgcatgccttcgctgtcagcattgtgaaggctggggcagatacatctcaaggaatccatggtagctgggaatactagatggagagaccattgtcccaaagaaagaacaaacaacagaagaaacaacctaccaacaaacagaaacccacaaacaaaacaaaagttccagactgttgcctcagcagctcagaaggagtatttgcttattatgcataaatccctggatttattctctattaacttaaaagaaatagaataagataaataagacacagcaactacatttgtagtagaacatatttagtattaatactctttttttggaaaaagagacttatcactcacctttcgtcttcttggcataacttcacaggtcatgaccccacagggaagaggcactgttgcagctgctgctgttgctgctactgctagcattgcaggagccccaacccagtacccgccaggacggggaactccacctccacctgtaggcagagcaaccccacctccaggtaagggttttgtgatgaataataatgatttggcttctgattctataaccttgaagaaataccatcttaagtattctgatggaggaaaaggcatcatctcattgtcttgctaaaaatttaggaactattgaatttcagggctacttttaatttcttatgaattgaaatagatgtgtttgtttttgctttttttgtttctgtttttttttttttttttttttttttttttgagacaggttttctatgtagccctgactgtctaggaactctgtatattcaaggtttggctttaaactcatggaaatctatctgcctctaccacctgagtgctgggactaaaggtgtgcaccaccactgcctggagaaaactgtgttctttctaaatatatgctggtgaaggtttttttctatttcttcattcacctaaattgacacactttctttactctcaattggaatgcaaaccagatttggccaaaatgaatatgaaacagccaaagtaccaccccccaaaaaaaaaaaaccaaaaaacccacaaaacatatactaagacacattcctctaacacataggaaaccaattaaaaacaaaacagaaaatatagtatttaagcaaaagataaaatgtagtaggagttcagacaaaggattatgagacaaactccacatatactatagagatagtatcgtttgccatcaacagataggcatgggtttccctttaagtgtgttgatatatccattgagactttttttttgcaagtggttaccaactagagatagcttaatgggtaggatgggagcttattttcacttccacttttagtacagtgacccagtgttacttagacaagtgcaagcttggtaaaatactacatgttcttcagtcttcttgctagacagacctctttccttggtgtcatccatcctcactgactcttcctcctcttcagtagggttcctgaggacttagttcagggatttgaaggaggccccagtattccaaggtctctgtacacattttctgcatgttggtctctgtatttgtttccatctattggaggaagcttctctaatggcttcacaaatcaccgatctagcagtgtggcagaatgtcattagtgctacattcctttagcagagccaataattcgttgtcccctaggtttgtggtcaatctggtctcaggttcctggccatctaaggagctgtttgtgattagtttcatctcaaggagaggaagttaaaccatatcagataacgcttattcccacaagctttgtcgctatcacagcagtgcctctttcaaccacgtcacctttttagatcatttggttgatgattggttgacatttgtaaatgaaaggttataagttatttgttattaatgtggcactcaagttttatagtataagaaacttcatttctcattgccattgttggctcatttctttaaccactttttgttctgaattgtaacagctttactgagctgacatgaagtgtttacttatttttgtcaaattttcaggcattatggctcctccacctggtatgagaccacccatgggcccacccattgggcttccccctgctcgtgggacacctataggcatgcctcctccaggaatgagaccccctccaccaggaattagaggttagtggttatgttaagacatccaggtccttcactatttatatgctcttaataacattaatggaatttttttttaatttttcctttctaggcccacctcccccaggaatgcgcccaccaagaccctaagatacagttgataaatctcagcccttctcttcccctacaatgcttcttgtgaaattgtgtacctgcaagctttttgacccctcttactgcattaactatagataataaatacatagagcaattcaattggggtttttctttgtctgctgattttgttaaagttagagtgaaaccaaatgtgtttcagtggtgaaattattgttaaagattactatattaagtttatattaactaaacacagatatgacatttgctcaagctaggttcttaggatcagatagttgaaatattttcctgatttctgacattcacttcaagcattggttcaaaatcttacagataaggaaaatcaagatccatttgctaagatttacaagccattccggttcaattaaatatgtttcacttaaaggtgtgtgaagatatttaagcagatatttaaattcacatcatttatggcactggtatgtcattattgcttatgaattaaaacatggaatgcaaggtattttccaatcttccaaacatgctctattacttagcagtctataattatgtttacaactatacatacatccatatacacacatacacatgcattccatgcatgcatgcgcacacacacacacacacacacacacagacatctatcatgtactgggtctattttggttttagtttgtacatttgtttaggtgcattaattggtattaaataaattataaaatgattttcctgaagaagacttattctcagaagtcaatgatagttcatctgtgtggggccttatgaaatttccagtatccgtgtcagtatgtctgctgatggtattgcacagcttctttcatgtctaggagttgctaattaaccctccctcccataatctggaggttggtaaacaggaggctctgatatttggatgtgagtgatgaccacaaatttgaagaaaatctatgatcttattcttgaactaaaagtgaccactcagaggtgagttgtgaaatgaacattgttttgctagtgtagataccagtctaaactatggattatagacaattaaaaacacttttcttaagaatttttacaagttagaatttacatcaacatgccagtctataaatgtctatggaagatcttttgatgagacatctttcagtttccattttaggggaatttgatgcaaggcctcatatagcctaggcttacctcaaatttcccttatgggcaaagatgactgcactctcatccatctgcctcaatctagtaagttctagtattacaggtatttctatcatgccctacttcatcctaattctaatatatagatgagcacatgtgtcttaaaacagtttgatattagctctctgatttcttaatatgcatagttatttttttctgaatccttaaataatttgacatcatttatctttctttaccagagcatgaagaggcttattatagaaacaatatgacacaaacacactttggaatgaggttttgtgtgtaggatagttcagtctagcatgtatgaaggtgtgtttgattccacagaaacaagccagttgcattggtgcatactgaaaattgaggccaggagatcggtagtttcgaggctatataatgaaacccagtctgaacataagatttttgaggattacttggaaaataaagattttcaactttttagtcattaattattatagcttagtttttgaaagattgtctgtttatgtattggaaactggtttcctagaaactattatgtattataggatattggtggtggaagtgaattgcacaagttataagagacaatgaaatagttgtctaatattttacagatttgcttctgttatatactgatttaaacaggttcattcagttaaaattttgaaattgcttcttagttcttttgtcaccttcaaagaagctgtttattccttttctttatatgtctcatatcagaacatggatttttttttattttttagaacatggattttataaaatgtattaaagcctgctttttgtagaacagtatccaatactgaaatatgttatatctgtattcatattattttagtctcatgtgttgtccttctgtcaatttagttcatgactgaagaaagaaattttcagtgaatgttatgaagtttcatgacttgactaccaccctgtagtattataacaaagctgtaaatcctaatatcgcagcttaagacagaaacataaaccatccaaggtaatgtaatcttttgttgaaaaataagaacattttacggagaccttgactggatttatgatgatataggaccttgtctgaatataatgatttcaaaaattgagcttacagtgactgaaatctagtcaatgtgcctcaccctagtggtacacacttgtagtcacagcacttgggatgctgtgataagattgtgatttccaggccctcttagaaaaggaaagcaaatgatcagatttgaagtgagaacattgcatactccggaaaaatggtgtgcaattttctattttctgtaatatcttttatataaatatttaaaagtaatttgtgggcttttcttgcattttatatttgttgaaagcaagatgaaatgtccttggatcacaaaaggcctggtgacatggatcctcataaaatggcgttcccaactcatgaaaaaaatggagagccacctttctagatttgtaaggtatatgaatcaggaggaaagggtaatgtttatggagcatgtacattgtggaatgtggtgagtatgtcaagctgttcttttggtggctacatttgattagccagtgtcactgtagaattattagctgactatatagcagttcttccttattttagaaagtattttaggtattatatacattcttggtatataatattaagaacccatgactagttggtagttgcatccatattctgatggattatctagctgacaattctttcagtgcttaaatatttccctgcctttgtgctgtgactttttttaaacctcctcattgacatttacagtgtattggtaggaatattttagttatctttgattaataggtaaaacacaaatgccatcacttttattagagtagagaatctttacaagcttaaatgggatatttttacttaaaagagaaaggtagtaggaactaggattgacctgatgagcaaagtaagtcaattagggagtgttagagaaccatatgctaagatgtttaagaaagcagttaaggggctggagagatggctcagtggttaagagcagtgactgcacttccagaggtcctgagttcaaatcccagcaaccacatggtgactcacaaccatctgtaatgagatctgatgccctcttctggtgcgtctgaagacagctacagtgtacttagatataataataaatcttttttttttttttttaaaaaaagcagttaagggaaaagaggaatggttcttgggattaaacttaggatttcagataggggattatgtgtatttacctgtagaacagtcatactgactctagagtagtgggttgttgctgttgggatatctgtagtagtttaaaaatgacagtggaaattacagagatgtgggattaatggcatgcataattaatgatatccatatcttttaaaaatagtaatttgttaaaagcacattttaaaagtttttgtaatcatcaaaatgttcagttagacataagggtgttaaatgaatcactttgaaggtgggtaaaaataccacagggtagatagtttgctttgttagaattggctattttttttatgctgaggtttaaacccaagggcattgtatatagtttctttcttagggtcaaactgacaagtcaggctgtgtggatctgtttggtttcattgttttgttttgtttgggtttttgtttctttgttttgccttttgacactgggtctcattatgtaactgagtcacactggcatccaattcataatattcctgccttgctgttgcaagtgcttattttataggctcgccacacacctattttttcattcactcactcattcattagtgtgtatctgtgtgcccccaccccctaccgcactccaaaggacatactttctgtttaccttacaactaactacatacttagccaggccagactatattatttttaagctgtttatctagctcggagttttatgtgaagcaatagctttgtaatgaacgtgttctcctaaatcttgaggtttttctctaacacaggcctctaaaactcatgtttctactatatcagtaccatgtaaccatataccactttccatttttacagtttttttttaaagtcccttctgaaggactttggctggacttatgatgagctatgtttactgagcatgatgaaatgatgctcaaaatgattactctgaagtctagccaaagtgtcagtttaagaacttaggtaacaacttaagttctgggaatatgaaacaagatttttttcaaggagactggagctgtagatttttccaatatagcaaaattggttttaaacctatttcattttatttttgtaaagtgcctttgtgtttctaacaccatagctttttcacctttctttctatataataaattctagaaataaagaacttggaagttagtgtatcgctcagttacccaaaatgtaccctgtgtgatagtttcctgagcatgttcctagccattttgaatgtattgttccttgatttttttttataagataggaattttatgttttttcccaaatgctgaggataatccagagaggttaatctatctttattatcataaagcattgatggagtagtcactctgtaattgccaatactgaatatgagaaatatttggtaaattttgtttaattttttgctagtgagatcacgtactattcctgttttcaaacacgtggttgggtggtgtcaggataatcatctgcataccagtttgattttgttcctctgaagtgtgagtttccctgagctttgtatgttagctactgctgtagtgattgcttgttgtgtggtatccttctgcctttgtaatacttacttctggatctttgcatatctacatgcatacacagcaatagatttattttcctatataattataaaacaattcttaatctgttggttatggcaaatttattgctgtgatatagctttgttttaaatatatgataactttattggcataatttagtaaaacatgtgaaatgatgattataatatcttacatggttcagcgataaactagaaagatacttttgtaggactttactttttggttaattagtaaaaatcagttagattttgacctatttgttaggttaaggtgttttaaatggaatgatcttataaaataactaatcacagggataatttctataatgtacttggtaaatgattttatagaatttatgggagacatgtcaatgtttgagtagttaagaatagtgttaaacaaggggctataatgtgtattaaatataaatagaaaaagtcatcattttaaagtacatttgagaagtcattccagttttatgggttgcattttcattttcattttctttttctttttttttttttttgcaatggaataagagtttaactgagggcataaagaggggaagtaagagggtggtagaatcagaggcggtagaggagaagagaatctattacttctcttccagccaggctatgaacatgtggagagggtgggtggtggccaggaatggagaaagaggggaagggaagagcaggggagcaagagagcaagaaagaagaaagagcagtttggcattttcttgatatgaagaaatagaagttgaattcctgtagtattataatcttggttagtgtggctttctttcaatgaacagtttttattaatttttttaacctttgttactatggagttttgttcagcatgctttgtaaatagaattcttggttcttcagagaatcttatgttactttatataagagaagtttttttgtcatgatacaattacaaaatacatcctgttatgacatctactgttatatagcataacattggcctacatacccaatagtgcaccatgttaatttaatcttgtgaagaaaagtaatggattgtgttttgcaagatacttaatgataatgaaatttctagacaaacaaattacaaaattactagaatgcttgttctggaatttctagactttctagttttatggcaagtaaagaaaattcatgacataaaaccatttgtaaggggtgatctatgtgacaacttcacatagttttactccaataagaagttaataaatattgtgagtgaattcaatgttaacacactatacccttaatatgctaatacatatctaaaagatacaaaatcatttaaattgaataagaaatttctggccaactttgttttcagatttattttatatacaaatacacagttatttatatcacagaaaaatttttatattttaaattggaattggacactgaaataaaagattagaactttggtggtcaacagaatatattatatggattcttaagtagtatgatacagcaacatttctctgttaagggttaattaggaaatgctaagcagaggaaaggtattcttttttaaattggaattgctggatcatactttgaaattgccaatttagtcaagcccatctgtcagtctaactttcagcttgtttttgcctgtatttattttaaatcagacctgacaggattgataactgaaaaataatagagtcctatctttgtagaaacaaaagtaccttcaactgccaaaaacacatggcattactctatatgtttaatgagtagaatgtttgaactgtgtgtagtgactttgtttaaagaacttgcttaatagagaccatgttaacacattatatttcttgtatttatggatagctgtatttaaaaacatttggccagttttcaggtttttaagttgttctgtatgaaaagacatctttatttttgctgttaaatgttactggacatttatgtaaggctcattgtggtggtgtgatagtaaaagctgaattacctgagcattttattaaaagctctctctctctctctctctccctctctccctctccctctccctccctctctctctctccatatatatatatatatatatatatatatatatatatatatatataaatagtttgtatattctttaatggcatcaaggtagttatttctgaggataattcaagtacaagaattatagggtcactgttttctgaaaagtatgtatgctatataaatgacattgaagtttcattttatttttctaatcactaaaatgtgtgatataatttatttttccaaattatcaaggtatatcagaattccatgctttgtagttatctgatacatggcaaaaatggaactttctaattcgtacgacttttataccaatcatctagtagttgcagaaatattgagactcataatttttaaatttataaatatattgcaattcctattgtcttttacaatgaagatgacacattgagagttgataaagcgatcatggagctcagaatttttcgtgtttgtttgaatcccagaggagcaatttataaacactatatatttatttactctattctcagaacagttgactgttttgtcatttgaattacacatttcaaaaaaaaaaaaaaaaagaatgacacattgggtattcagttgtctttctgagacttaatgaggctaatgattcaaagttttttttttaaataatcaacattcatgaagattttgtactacctcttggaacacatataaaattttgtatgtgttcccttattgcatgacaatattcaagacaactttgtaaataatagtcaaatacaaaattttaacatctagtttttctagatgtatagagtgtcacagggtataattttgtaaatacatcagtatgagcttttatgctttttaaatttttttgagtgtgatttttaaaaattgatcttgtttgttacttgttaataaataacatagaagaatgagaaaaagtattttaagttcaacactggctactcatctactggaaaaatttcattaaccttagtgtaaggcttattggacacacaaaactatttataatggcatacataaattatagtcatgtggttgtagtaataaaaggtcattatctaaacatttgtatttaggcattataggaaatatgtcttggaagagtttcgtctacatttgtgattgagttaatacagtattatatttacggtacatgacagcactcaagacatgctgtaaatatatacatatatttatgccagtttgaaatatcttttttacagatgcattcttaacacagtataagcctgtaaatatttcattatgacctaacattaattaaattataccagtaaattcttttacaatggaatagataaatactattaaaatattaaatataaaactgtttatgaatagtttctcatgtagagaagaacaagccagtttttctatactgtttacatgaagcaaaattacaggaaaaaaattgggtgctttttatctccaagatagataaactatgaaaaactattaataaattttaagttaattagaaaaattttcaaaatcattgttagtccacgatttaccattggcatgcttatttacttttacctgcagtgattgcattcacatatttaggtcataatagtatatagattaaatacttttaaattatgtttatattgtggatttcaatttatattctggtttacaacttataaagatagtatttcatttataattcagttaattctgcaatctcaatgttatgactaaattcaatttgtggtaaatacatatcctgtaacttttctaaatgttttaatatgtttatatatctttaagctattttaaaattttgtatattttcatctagtattattaaaggtaaatacctagtatagtgtacgaaaaaacagcctgtatcacattaaaagcaatcaagagaaattaaaatcagagttaggattaatgagtaacatttatcccagcacctttcaagattatacacagctccgtactcagtttgtggacagcctgagctcatttggccttgtgtcaaaagaaagtgtgaaaacagaaaaactgaacacatcccttcaacacaaaaggaattgtaagaatatgtattatttgttgcaattttagagttatctcctaatatttcatcatttgtgattctcaaatgtaatttgattttttttgttggacagtaagatagccaaataccagatctacgaaaagaacataaggattgcagcttaaggtgaatgtaatttaacagtgaaatattctctagaagaggggtgttgtattataaattaaaaaaagaaacaagttgccttcttgtagacatactttagttcatactaaaagagatagttaagaaattcctgattatgcatatgttgtgtcattaaggaaattaatacttttgtatcataatatgtattattttacagtaataattgaagatttgtgcaagtcaattaaactatacatgcttggaaattgccacatgggaccatcttgaatgaacagtttatgcaaacagaaaacatgttcaggaagaatgttaaaattttaacacttgtaaatagaaagaagatgacatttgcctgtctttgtaatttatgagggtatttgcaaataagcatcaaaacaagaagaaaatattaaaaagacattttgtgccaggacatcatggtagtgctggattgcctatccaactctgtataaaggtttttcaaacaatttgtgaagaatgttagtatcttcagagtcttctgcatcagcaaagagtagtgcattaactaatggaaaagagaagataaaatttctggtaagtattagtgacacatatgagtgaaatataatgttttagctaggatttaatgctgtgaagagacaccatgaatgtgagtatccttataaaggggaataattggtgctgtcttacagttttagaaaattagttcattttttgtcataatggggaacatggcattgtactggcagatatggtgttggaggagctgagaattctgcatcttgatcagtaggcagcaaggagtgaccatgtgccctgctgggcattgctttagtataggatacctgaaaacctgcccctgcaaacaggccacatgtcctaataatgtcatttcctatgaactgaacatacaacacatgaatctatgtgacaagtcctgttaaatgtatcacacgtagaaactaaaaagtattcagcaataaatattggtaatgtcagtcatgcttatgaatatagcatgctgtatcttatgtttttgttatgtctcatttaggatgagttgcaagttgtctactacatttttcttagaatataactcaggatcagaaacaggccgaaacacttttccaatcatccaaattactttttttattaatgagacatggctgttctagaactcactctagaccaggttggcctcaaccccgaaatcggtgtcttccaagtgctgggattaaagacatgtgccaccactgccaagcctgtaaatatataaattatataaataaataacaggattgtgcttactttgttggatgtgtttgatttgcctgagggatttccagtatatactcatatagatatagatatagctagatagatatgtatataagtagatagatagatagatacatacatacatacataattctttcaaatgtacagacggatactttaaatagtaacataatttaaataaaaacttggagtgttcaagaagataatttagctgttatgcacaccaactgtatttattaatgaccttaggtctgttcccatctatcagttgctgcctacaactacagctccggtgtacatcttgcctcagacacctgtcccatgtacaggtacatgcacttgaatgtaaagtaagatgctagggtcaaagctaaatttacaacatacagtacattttcagaggacttaagttaggatttcggcagctaatcacatctatcttttgtagtatctgaaacctctgctctatgagggctcaatggaaaatggatagaagcatttggtattaaatataaattgttttttttgttcaagaccaggctaattctcatttttttttccgtatacatcctactctatattgggtactttatttttcaggtgctcatgatgactagtccgaacctgtgaacttctgagaaaatttacagttctgaaaactagaggtaagaaaggatttgagtttttttcccccattaggtcaagaaaggtaatacaatttgaaacattcccatgcattctaattttctgagttaaattaatttctttgtgattggtgtggaaattgggcctcccatatactaaaccaagtgttgcataaagaaacaacaactgtagtttgaatcagtttatttttaaaaattgttgagaggtgtagtaggctatcatcaaataccctatgtggttgaggataaaggtaaacgtctgattgcatgccttccagtctcatacactgggactagagatatacttactcattcctgaactatgcagttgcaggaattgacgcatttgttctttccttaaaagtaccagctaacaatattttcagacctttcatcttaataaaataatgattccatacatggatgcacattatcctttagttaattgtcttaatatattccaatactccaatagttacttcacctatatcttagttaaaaaaaatgcattaacagggctggaaagaagatggctcagcagtaagcttttcttccaaaggttctgagttcaattcacagcaatcccagggtggctcacaacaatctgttatgggatctgatgctctcttcttaggtgtctaaagacagccatagagtactcccatacataaaagaaaatcttcaaaaatctaacagtacaacaaagcaaacacaagattaacaaagttctagagatagtagttagtgagtattctttgtgcaaagtccccaattttagttcctagcatccatgcattgtaactcctgagtatcaaacatgggcacaagcaaagacacatagttaaagtaataaataaatatttaaaaacttgacccaagcaatgtgtatttatttggcttcaaagtttaataggcactcaagaatcttacgggagagcatggcaccaggagcatgatgcctgtggtcactttatatccttagccagaagttagagaatgatcatagggataagagtggggaaaaataggttcaagatacaatctataattatagcttgaaagtgttgtgtttttttttttttgtcaaagtagcaaggataattactgtatacaatgaaaattgaaataactaaacaaaacagaaaactgacagcccaaatcagaacactaaagagtaatattacaaattacctctctaagtaaaatcattttgaataaatgagataataatctcatgtcattcaaaatatattatatttttataataaaaatgcataaatgatgctctttgataatgaaataatagttgtgctttttttcctgtgttctctctcaggtggttaccgaattgaatagccgttggttctacagccactataatgatctgaaaagttgaatgtgttgcatgaacactttcaggaatcataatagaactcagctaattagatagagactggaatgttgatttgaagacaattactttataaagattttctcattgctgcttttgcattatcccaagaagtggagacactactacatggataagaactgtatgattgaattgactttggaatcatctcagtattgtcataagtatgaagtgtatttcatggtacttttgaagttagttatagaattttttcaattgatttttctatttttcaaagggtttaggtaatatgtagcatagtctgacttgagtggtaacattttagaaatataccaggtactgttagggcaatattgtgtgaagatttacttttatagtgcatgccaaattttgggttttctggtacattttattggattttatttattaatatttgttataagagcagctgattatgggttaagatgatagtattacagttatgtgtcaaaattctattactttgaactacattggcttggtatatcaagtctacatttgattaaatgtagacttagcaggattaatgaatttggccattaaaactacaggaattttagtcaacattcctctcatatttgtgtatttatgtatgtatgtatgtatgtacaggaattttagtcaacattcctctcatttgtatatgtatgtatgtatgtatttatttatttatttattatcaaatcatgctgttcatttctgctcattgtttgagtttccatgctaattatctattattcataagtacatttataaataagtctgtaagcaggtcatcatgtatgtcagataaaatactgtgttttctactctctgttttattactaagttgtatatgaattatgcattaaatacagaatgttctctcttatgtcatagtttgtgtttttcttttgtaagcatctttttggtcatgtcatacttatgtgtgttatctccctagtttttcatcagatactttgcccttccttttcctcattattagtgtgctagaatatttaataatgcatattttaatagtagtattacttctcaaactcaagcatattagaacacaaaatttgctttatgtctgttttctttctatgtttacctgttctatatagttcagactcttttctcttatttttcagaatattcactgtatgtagtcaattttttcctcagagttgatggttataaatacttgtcaagttggaaaaattcacttttacttttatttgcatcacacttactagattagagactagattgctttaaattgagtcttcatttacaacttcaaggtatgtctttctctttgtaactaaatgacttcgtacctgtgcattccatatatttcactagtataatgtctggtaacatcaagtcaatatgttggtatatgaaattcattttcagatctttacccagtagtctccattaaatttctaaaatggtgaagtccttactatcatttgatcatgagtaaaaggattaggaattatttctagaatatacaagcatgaggtactgttatattttcttattaatattccatactggttttttctgcaaagtctctattggttcaaatgtttttggacttaacctatcttgtttaaactatagcctgggacacattgcaatctagttcaggttgaaattgaacttttaagaatccatttcctcagcacctccctcaaataaagttaacatttttgagagttgagtatttttcaattttattctttggcctatagagatatctaagcaattcagagtaattactacttgtacagattaattccattactggcacctattttaggctgtatatttgcctgaaactgcagctacagttgcaagatacaatacctctcctctctgggaacttagactcatgttcacatacccccatacaggcacatagtagcaatatttaaaagtatcccatttaacaaatctgaattcctaagcaactgcattttttgtatgtttgtatttgacattatttctgtgttttttcctgaggccatttaaatggaataatttaactagattatagcttgttaaacttaagggtgtaatggtataaacttacaacctctttttgatcattatgtaggactattagtactttgatgccagactggataaaggctctcccaaaattgaacagtaaacgtaaacgtttaaagtagttgtgtacagaattttgttttaatcttcatcatatgctgaagtgtttacctaagttcaggaaataatattgatatatcaatactaactaatatataagccttattcatatttgtgaatcttattcagttttttattactaatgtaatgattttttatgattcatatttgacacacgtatcaaaaaatagtaaaacagttgtgtcattcttaacattttttaaaaaaagtatattatgtataattttcacatacaatttaattttaacttatttgtaaaaaaatgtgggatttatattttggaaatatttctatattcctcattttaaaatatgcacttttatcatgctctcctaacatgaaagccttaccacttttgtttttgtttattggtctattgatttttgttagtgatcctgcttacagcactattttttttaacataaatcaggctgtgccactgtatcacttcttcctagcaactattgattgcctatagatccccaagaagtgtacggttatatgaaacacaccccataaataatcgaacacagatttatgctttacattctccatctatgggtgctgtgaagccatttttacagaagccatttcatgtcccgatggcagcatttgtgagcgctttgctcttaaattttgaaacttacctttcaaagccacttgctcaaagatggttacagctcagtattgactgtttcactgatgctaaaaagatgcttctcttacatgaaataaatttagaagcaattgtttagcttaactcgttccatatttgtaccatttggctcattgtacttggaagtatggttggttgattgctgtgaacaagaatgaatttgtaccacaaagcactttccatcctgaagaaagccagtatagattcatttttcagtttctgcgtgttgaatatgtatgacctataccaaaaacatgtggtataatctgcagcatgacaataactggttttggatgacaaataagagcagtggcaagttgccttggagtcttactgatatgaacatacatataataagtattttatatcaggtcctgggttttgtttatatacatatacatatacatatacatatacatatacatatacatatacatatacatatacatatacatatggcttctggaatcacccttttccagatgtcagtatacataaaaacatttcaaaaaaatctgtaattctacttatgacatgttctctccttcaatgatagaaccactctaaattctagtattttcagttaaacccaaattaaaaattcaatgtgtgataaatagaaaacaagtaatttgtgttcctggaacttagattcaactcattctacagtttcagccattaagaagtaaaattggtttatttgttaatatatactattttgactatcaagatgggatcttgaagtagatccatttcctaaatagtaagagtatcagtgaacatgaatgaaattatatctccagtggtcattcctgtaggaagagtaatattatattttctaacagtttttcacttggggggagatttctacactgatttccttcatttctgaatcagattacctcttaaagctgaacaactttccttatcacctttcattcattcgtgtttacaataggaaccattttgatggcattattaaatttaaaggtcaacgtagttcaattttcatttttctgaagtctgggtattgagcatctttaaaataccccagtttgcttccaattttttcatatgacctttttaaaaatgtttgatatttaataatcttcaaggtcaatatttccccccattctgtaacctaccaatttcttttgacttgtgaactgtaagccataatacatatgctaagaacctgtgaggtcaagaaacaaaaaaccagaaaacatgagtcgaataacttcaaggttgctattgagtttgttttgtgttggccatcttctgatgtacatgtgacttctgctaagagtagttttcatcagtgagacttcattagagaaaaatgacttttcatttgccagctattataacttggaggtaggtagcttcagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattattattataacttggaggtaggtagctttagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattataacttggaggtaggtagcttcagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattattattataacttggaggtaggtagctttagcattgaggaaacctgtgaggtcaagaaacaaaaaaacagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattattattataacttggaggtaggtagctttagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattataacttggaggtaggtagcttcagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattattattataacttggaggtaggtagctttagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattataactttgaggtagcttcagcattgaggagtgagacttgtttctactttgattttcagctgtgggaggtcaactgatgtagacacacatgtcccatgtgcttgatgctacagttttcatatgtgactaggttatgctgtatttagaaagtcttgatccttggtgttctacataccctctgatttttacatcattctgtctcttctgcatggttccctgagaagtgagggatggaatttgatggagacattctatttagctttgtgcattccagggagttttttaattgctcttttcagcaatggtacctttatggcgagtttgggaagaacaacataatctttgtggtagcctgggttgcttggcaattcccattggacccctttgtacaacaactcaactacttgtaacacaattccagtaattgaagattaatttgattataagagattgccagttcggcctctgtctccattatttggtgacttcagatagattatatcccttttcttggtccccacatagtcattactatttaatctattttcctttctaatccctatattggaattttcatttggtgatgagagatgtccagttgggaatttttgtcttctgttcttcggtgatttcattaagattctgttcatacatgttctgtgaggggttgtactaaaattttgatggggattacactgaatctttacattgattctgaaaaaatagtcatttactcctaatgatccatggacatagatattttcatcttctgatatctttctacaaggttttgttatactttgtttcattctgtttctatttggctgacttctgctctgagcttgactgtttcctgcatctagtcctcttgggtgtgtttgcttttttttttttttttttttctagagctttcaggtatgctgttaagatgtgagtgtaggatctctccagtttctttatgaggacaattagtgctatgaatttttctcttaccactgctttcattgtgtcttataatttggtatgctgtgttatcattttcattgtgtttcaggaagtctttaatttctttatttgctctgaccaagttatcagtgcatagagagttgttcaatttccaagggtatgtgggttttctgtttttgctgttattgaagtctagccgtagttctagccgtagttcatggtggtttgatagaatgcataggatgatttcaatcttcttgtatcaaagggttgttttgtgaatgattgtatgctcagttttggagagggcaccatgaggtgttgagaagaaggtatatttttgtgttagcatgaaatgttctgtatatatattattaaatccatttgtttcataaattattagtttcaatttgtctctgtttagtttctgtttcattgacctgcccattggtaagagttgggtgttgaagtctcccactattattgtgtagagttcaaagtgtgctttgaacttgagtacagtttctttataaatgcgtgtgcccttgcatttggggcatagatattcagaattgagcctttctcttggggaatttttcctttgatgagaaagtatcttccatcttgcttgataacttttgaaaatctattttattgaatgttaaaatggcaactgctgcttgattctttggaccatttgcttggaagacttttttccagccttttgctctgaggtagtgtctatttttgtcatttaggtgtgtttctcgtatgcaggaacatgctggctcctgctgtatccagtctgttagcttatgtccttttattggggaattgagtctcttgatattgaaatattaaagatgatggttgtttctcgtatgcaggaacatgctggctcctgctgtatccagtctgttagcttatgtccttttattggggaattgagtctcttgatattgagatattaaagatgatggttagttctgttatgtttgttgtaggtggcatgattaatatgtgatgctttccttttgtttttgctgtgagataattaatttattggtttgacttatgatacattaatgaagaattgttttttatctctcctgactaaaagcggttaaataccattttttacattgtagaatttttatgccagctaattaatttgttcattccattgttttggtaagggtattcaacattatacactgagatagtaacagtcttttagtacaagatatgtttcttggagactgctactggatgaaatcttttcattaatataatagctcatgaataaatacaaagtatgtttcttatttatatccttttagtctcatgaactccttccaccatcttgtcctctttgtgactttagcatacctagttcaattaatgctgcctttttagtcatatgtgtgctgtgtgctgctccgtcacttgggggacaattgaccattatgtttattatgtgtcatgtattaattcctataattttattgtttgtgatactttcttagttctcattttgttatataatttacttttttctttgtgcctttttgggtactttcacctttcattttaggatgagtatttcttctactgccctatatagggtcaactttgctatcatataatcctttaatctgcttatgtcatagaatgttttaattaccattccaatgtcatagttgttttgctgagctaaataactgggttcaaaaatgtgtcctttgaggatttgaattgcattttccagtacaattctgctttttttgttttctgataagcttgtttttatatatacccttgtgtttccctatttcatttttcaatatatcatttttctgtttgtttttttgtcacaaacctattttctgttctacatgtatcttgtctcagaataaccatcctttccttcaattggagtatatttttttactatgatagtactaaaaatattttctatttctttttgcatgcagtttttccattcctctatgtccataattcataccttcaggatatatatatatatatatatatatatatatatatatatatatatataaacttaaggttctccttgacgaaattaccaaatttctgccgtgtttccttccttccttccttccttccttccttccttccttccttccttccttcctctttcttttctcttccttctccttctccctctccctctcctctcctcttcccccccttgcttttctcatgtttttattggacattttcttcatttacatttcaaatgttatcccctttccgtgtttcactcccagaagccccctatcccatcctccttcccctgcttctatgagggtgttcctctacctacctacccactcccacatccccaccctcagttcctctacactcgggcatctatggagatttcatagaaccaaggacctctccacacatagatgtatggcaaggctatttattctctacaacatatgcagcaggagccatgtgtacccctttattgatgacttagtccctgggtgctcttggtagactggttggttgaagttgttcttcctgtggagttacaatccccttaaactcctgccctttttctagctcctattgaggaccctgtgcctagtctaatggctctggcaggacctctctgtcttgttttctttcatgccttgattttttttgccttcatttcccttttcttcttcttcttcttcttcttcttcttcgtcttcttcgtcttcttcgtcttcgtcttcttcgtcttcttcgtcttcgtcttcttcgtcttcttcgtcttcttcgtcttcttcttcttcttcttcttcttcttcttcttcttcttcttcttcttcttcttcttcttcttcttcttcttcttcttcttcttcttcttcttcttcttcgtcttcttcttcttcttcgtcttcttcttcgtcttcttcttcttcttcttcttcttcttcttcttcttcttcttcttcttttttttttttcaagacagggtttctctgtgtagccctggctgtcctggaactcactctgtagaccaggctggccttgaactcagaaatctgcctgcttctgcctcccaggtgccgggattaaaggggtgcgccaccacttgccttcattttctatcctattttcactgtactctgtatttgacttgtttagtactacatttctaggataatttaaattttctgtagtatttatattacttgcctttatttaataaaattatatgtccttaacttacttattttatcatatcttctttgttgttttctttttggagttccaatatttattcacttttatttatttagggaaagaatctccccagacctccactataatattagtcaattgtaagactgtcaaaggcctcacttaataggaaaacagaataatagttgaaaatacaaaggtcatctcttagtcactagttcaaggaataaatgtatattaacacaatgaatataagtttaataaaaagaaaaatattataaatggtatataacagcagggatatgatgaaagtaggggaggaggaatgaaaatagaggtaactgtagggaggtgctcaaagtttacaggtaaagctttgcagtcagatatctcttgatagtgtgaggcacaatgacccagaagaccatggccagaacatgtaatttgcacatacaattagaggaaaacaggacagaggaggaaaggaaaaaaagagaaaggaacaaaagcaaagaataaaaaagtagcatagtttaagatcagagcaaggtcaattactctggttattaaaaacaggatagatacaggagaaaaagttagatggatatatagcatacaaaacctatgatgtgaatgggtgtgctattttccatgaggcatgggaaatctagggtttactctgaaaatctttattcacccttttctaacaattatcaactgtcaataatgctccaggaattattgggctttgaagataatctatatattatccatctattgtgagactttgcctggcttgatgttttgcagataatcacggcttctttgaattaataagtgttaattttttttctctttttttcctttacttactttccccctacctcaagacaataatcacacagtactcttctacaaccttgtcacttacatctttttgtttccttctatacaatgtccataagccttggtggaggtggtaataatatactagtcctatgtggagctgagcatctagtcatttttatcctcaacatgaaaacaaattgcatatatttccattaacatctgtctactgtgaaaagaaactacccagacctaagctgatattggccttaatttgtaagcataattataactattcaaaagggaatttggcataattattatttagcaaaacagcaatagcatttgtatcctatgacttaaaatctcttttttgttgtattttgaggaggattacactgccaggacttgcttgtaattgtcatgctgctgttgaagatcaatactgtagcctacagggtctgccattgggtgggatagttgatatgttttctcccctagtagcttacagcagaacattacaacaccagtgaagataaccagcatgaacaaagtctcccagttttcagattgatttccatttggtcttaagtgtgatttgcagtagtgtcttaaaaagtagttctgtgtaactaggggaaatgtcagtcactttttgttggtttagagctctggagacattttggccaataatttatagtgatgtagcccatgacttttaatattttagttcagtaatactagcaatgaaggagaaatttttgtatttcctttgatacttatatctctgtacatcaactgaagtatgtgttatcttttaatataagttctttccatgtgattatggtgggtttaccaaagtctgtgttagattggaaacctctgggatctttctgacttaactgggacatatcctatcttgtgctgagagtaacatttagcgacccctatcttatgggaaaattgtttagccataaaaagtaattttccttgaatgcttacagattaagtagtgttttttaaatatatttttcataaatcattagtctgttaaacacacactattcccatttcttctttgaacccttgagtcctgcctgcttaactatttaagtctcagtattcctgaccacatcatttatgttactatctcttgtcatatttttgtgaagtgtatcacaagacagttggcttctatatggctttatgtgccttcttcagcctgatttttctatacttgaacatactctgattgggcctttcctccaccaggattaaacttcagaaattattgttgttactacaacatactaccccttagctcttattttttttatagattcatttatttactttatgtgagcacactgtagctgaacagatggttgtgagccttcatgtggttgctgggaattgacttttaggacctcttctagttccagtcaaccccacttgctctggtcagccctgctcactcagtccctgttctctccagcccaaatatttatttattaaaaactataaacaggccgggcgtggtggtgcacgcctttaatccccacacttgggaggcagacgcaggcagatttctgagttcaaggccagcctggtctacagagtgagttccaggacagccagggcgatacagagaaactctgtctcgaaaaacaaaacaaacaacaacaaaaataatactataaacaggtgcactgtagctctctttagatgcaccagaaaagggcatcatctcattatgggtagctgtgtgccaccatgtggttgctgggatttgatttcaggacattcagaagagcagtcagtgaacttatccgctgagccattttgccagcactactccttagctcttaacatattatctttcaaatgcctttttcctttctcagaactttaattgttccatgttaatcacacacacacacacacacacacacacacacacacacacaagaaatgagatctgaagctaggattcatgtaggggaaaactctgtttgccttacttagtcttgtttaaattcttttgatttatttaccagttacaaaatttcaattttctttagcaccgatattccatagtacaggtttaataattatctcgtcattcatctgtttatgaacatgttccactttctagttattgtggatagagcagcaatgaacagagatgtctaaatattccttatcgtagtacataaagttctttgggtatatgcccaggcgtagtataactgaatcatatggcagttgtacattttctctgtgttccccttgctgtcctggaactctctttgtagagatgaattgtcttttactcagatatctgcttgtctatactcctgagtgctgttattaaggtatttaccaccattaccctactgatagttgtatgtcttgtaaccagagtgctttggaaattgtctgggatagttcatattttataacaacagtgtgagccgggcagttgtggcgcacacctttaatcccagcacttagcaggcagagacaggtagatttctgagttcaaggccagcctgatctacagagtgagttccaggacagccagggctacacagagaaaccctgtctcagggaaaaaaacaaaacaaaacaaaacaaaacaaaacaaaacaaaacaaaaaacaaaaaaacagcagtgtgcatgagatttacacaatattggttgccctttttgtgttgtgaaatataatctttctaactatacacacacacaacctgcacccccaatattatacacatagtacatatatagataaatacatatgggtataaggccaggagtggtataactgaatcatatggcaattatttcccatcccacaggattcagttattcgtgggtgcgagggggaccacaaacctggaaggaaatgggaggaagaaaaagagaaacaggagaccaagaagatggtacctatcaaggtctcgtttattgggctgaggtgccttgtttttaaagcatacatcgcggggaataggggaggggtcaaggggaattttacaaagaagcgggcatctgctgacatgggggccaaagtcaggtgccagacagcgggcactctgcttcttatctctggaacatagatcctccttgtcagccttgggtgtcaggccgggctcaggcataactcatgtccttggatagcatgggagttcaggaagagataaggaagaggggaccataattcagcttttacagcttcaggtgctaggaagggaatagggaggagggaatgataaccatctcctagcaagaggccatttggcctgttagggagattgtgaagggctcgctttctcacggtatggtctctgacaattattaattcttttattagtttattttaaagacaaagtatctctgtgtagcccagagaaactcaatctgcagatatatcagatctcatttatatgtgtgtatacacccccctcacacacatacacatatgcacatatgcatattattcatgtatgtatacatttgtacatatatacatgtgcatgtaatatacatacatatatacatgtgcatgtaatatacatacacatatactcgcatgcctatacacacagtgtgtgtatgtgcacgcacatgtgtatgagtagtagtagtagtagtagtagtagtagtagtagaagtagaagattcttttctgagggtaataatgtcatttgaggcggggcggtggtggtgcacgcctttaatgccagcacttgggaggcagagccaggcagatttctgagttcaaagccagactggtctatagagtgagttccaggacagccagggatacagagaaaccctgtctcaaaaaaccaaataataataataataataataataataataataataataatagtaataacaataataacaataatgtcatttgatttaggaattttccagtacctgtaatttctccattcttgactctgccttaaattcaactagacagctggcttttaagaccgacttgtgagtatcctttattttatgcttactaatatcttcttgttctggtgactatcataggtgttacaagtaggtaagccattttaagtggataactgacaaaaggtaccaaaaatattattgctatggaataatgaattaccacgtgaaataatgatgttatgagagtcaatgggtattgcttagaattaaaatttaattttatcatatgaagatacaaaaggtttctttgacttcaagctgactagaatagatgctttatagaattcaaaatgaatttgataggaattgaaaatcatcacagggtaatattttatatttgtaatcccaacacttagaaggctaaatctccaaagagaacaagtacaccatggcagcttagagtgtgtctctgttgacataaacaacaaagaaaccaaaatgatatgtttccattgacattttaagaaaaattgataacgtggggctagagatgtgaaatacccgttaagagcatatgttgcttttgcacagaatgtaggttgtttttttttttttcccccagcatctatatgatagttcacagtaacttgtaacaccaatcccaggatacctttatgctgttttatgtcttctgatataagcatatacattcttgcaaggagatactcatatacataaaatagaagtaaattacaaatagcaaaacacaaagaggctggagagatgtttcagcagacaagagcatgtgctgttttctggtttccatgggcactacaatcatgtacagaagcatatagaaggacatatacatatgggcataaatttaaattttattattattctttaatcttttttacagtccagttgttatccaccacatggttcaccctccaaaacttccttattacattcctcctcccccatctccaagaggatattcccaaacattcaatcccatcagatctccccactccctgagacctcaagtctctctaggattaggttcatctctcactgaggccagaccaggcagtcctctgtattatatgtgttgggagcctcatatcagctagtgtgtgctgtttggttggtggctcattttctgagagatattggggatccaggttagttgagactgctggtcttcctatgggttttccctcatcctttagcttctttcagtctttattggattaaaccacagtgttacccaatttctgtccattggatgagtgttaaatatcagcatctgactctttctgcatcctgttggacctctcagagggctgccatgctaggctcctgtctgtaagcataccatagcatcaataatagtctcctcttaaactgcatccaaatttgggatggtcactggacctcctttccctcagtctcttcatcattttgtccctacagttcttttagacagggacaattctgggtcagagtttttgactgtgggatggcaacaccatacctgaacttgatgccaggtctttatactggagatggattttacaagtccctctccccactgttcagcattttatctaaggtccctctctttgagtcctaaacgtctctcaccacttaggtttctggtacattctaaatgctaccccacctcctacctacctaagtagcctgttttcattctttctgcttgtcctcaggaattaactccagatccctcctataatacatgatcttgttccccttttctcatctctgttccctctcacacccaggtacctccctccctctgcccccatgattgctttcttatccatccctatgtgagattgaagcatactcacttggggtctttagctcgttaacctttttgagttctgtggattttatcctgggtagtctataattttttggccaatacccatttattagtgagtacataccatgcatgtacttttgggtctgagttgctgcattcaggatgatactttctagtttcatttatttgcctgcaaaattcatgatatccacattcttaattgctgaatagtattctattgtgtaaaggaaccacactttctgtatccattcttctgttgtgtgatatctgggtaatttctagcttatggctatcccaaatatagccactatgaacatattggaacatgtgcccatgtggcatggtgatgtatcatctgggtatatgcacaagagtggtatagctgagtagatctatttccaattttctgaggaacctccatatttattttcagagtagttgtaccagtttccatccccaccatcaatggagtagtgttctttcttctccacattctcaccaacatgtgctgttactcgagtttttgagcttagccattctgattggtgtaggtgaaatcttggattcattttgattttcatttccctgatcactaagtactttgaacattttattaagtgcttctcggccatttgaaattcctctgttgtgacatctctgtttagtcctataccccgtttttaatagggttatttggttttctggagtctagttcttgagtttttgtatatattggatactagccctctatcagatgtaggatttttaagatcttttcccaatctgtagattgccattttgtcttattgacagtgttctttcttacataagtttttcagtttcacgaggtcccatttatcacacttccttcccaccccaccccacctgacctctaaactccctggggcctccagtctcttgagggttaggtgcataatctctgaatgaacacagacctggaagtcctctactgtatgtgtgttgggggcctcatatcagcctgtgtatgctgtctggtggtccagtttttgaaagatctcataggtccagattaattaagacagctggtcctcctcccttctcctcagcttctttcagtcttccctagtttaacaacaggggtcggctgcttctgtcctttgttttcgtgcaaataactgttctgactttcagccacttgttgggtctttcagagggtagatcctttttgtgatcatagtctcagtaatagtgtcagaccttgggacttccccttaagctggatcccactttggacctgtccctggaccttcttatcctcaggctcctctccatttccatccctgttatttttttcagacagaaacaattatgggtcagaggtgtgactatgggatggcaaccccatttctcacttgatgtcctcctgacttcatgctggaggtgggctctataagttccctctccctactgtcaggcatttcaccaaaggtccctcattatgagtcctgagcctttgaagttctgattgggaaatttacccctgtgccaattagtttgagtctatttcccacatactcttctattagattcagtttatctggatttatgttgaagtcctcggtaaacttggacttgagctttatgcaaggtggcaaatatggacctattttcatttttctccatattgattggacctattttcatttttctacatactggttccagtttgaccagcaccatttattgaagatgctttcttttttccccattatatatttttggattctttgtcaaagatcaagtgtccagaactgtgtgcttttatttctaggtctttaattctatttcattgaacaaattgtctgtctctataccaatatcatgcagtttttatcactattgctctatagtagaatttgaggtcaggcatggtgatttccccagaacttctttcatatttaagatttgattttgctattctgacttttttttccatatgaaattgaaaattgttctttccatgtctttgaagaattgtgttggaatcttggtggggattgtgttgaatctgtaggttgcttctggtaggatggcgatttttactgtggtaattctgccaatccatgagcattggagatctctccattttctgaggtctacagtttctttcttgagagacttcaagttcttgtcatacagaactttcacttgtttggttaaagttaccttaagatattttacattgtttatgactattatgaagagtgttctttgcttaatttctttctcaacccacttatttttttgtttgtttttgtttttgttttttttcaagacagggtatctctgtgtagcactggctgtcctggaagtcactctgtagacaaggctggcctcaaactcagaaatctgcctgcctttgcctcccaagtgctgggattaaaggcatgcaccaccactgcctggcacatttatcatttgtataaaaatgaaggctactgactcatttgagttaatattctatccagccactttatgaagttgtttatcaggtttaggtgttatctggtagaatttttgggtttgctcatgtatactatcctatcatctgcaaatagggatactttgacttctctgccaatttatatctccttgatctccttttgttgtctttttgctccagctagaactttgagtattatattgaatagatatggtgataatggacatctttgtcttgtccctgattttagtgtgattgcttcaagtatctctccacttaatttgatattgattgttggtttgctctatatttcttttattatatttaggtatcagccttgaatttctgatctctccaatactttttacattgaaggggtgttatattttgtcaaaggcctttacagcatttaatgagatgataatgtgattttttttagtttgtttatatagtgtgttacaataatagattttgtatattgaataaaccttgtatccctgggatgatgcctacttgatcatcttgaatgatgtttttttttaatgtgttcttgaattcagtttgtgaaaattttattgagtttttaaatcaatattcataagcaaaatttatctgaagttctcttttttgttggatccttgtgtggtttaggtatcaaagtaattgtatattgatagaaggaattagtgttgctttttttcctcttttgtgaagtagtttgaggagagttgatattagctctactttgaaggtctggtagaattctgcactaaagccatcaggccttgagctttttttaattgggaggtttttaatgacttctttaatttccttagggtataggtcttatttaggtagtttttctgctcttaactttggtatgttatatgtgtctagaaaaattatatatttcatcaagattttccagttgtgttgagtatatggttgtgtagtagaatctgatgttttttttttaatgtcctcagtttatgtctctttttatttctgattttgttaaattggatactatctcagggcccttcaattaggttgcctgctggtttatctatcttgttgattttctcaaagaaccagcttttggttttgttgattctttgtatcattctctttgtttctgttgggttgattttgaccctgagtttgactctttcctgccctctactcctcttgaggggtgtctgcttctttttgttttagggctttcagttgtgttgttaagttactagtgtatggtctctacaatttcattaccagggcacttagtgctataaattttcctcttacgactgctttcattgtgtcccataagtttgtgtatgctgtattaccattttctttgtgtttcaggaagcttttaatttctttcttacttccctgaccaagttaccattgagtacagacttgttcagtttccataggtatgtgagttttttgttgtttttgttgttattgaggtctagctttagtcagtgttgaactgatagaatactcgaggttatttcaatcttcttgtatctgttcaggcttgttttgtgacagattatatgatcgataatggagaagataccatgaggtgctgagaagaaggtatttttttttgttttaggtgtaatgttctgtaaatatctgctaaacccatttggttcataacttctattaattcactgtgtctttgtttagtttctgtttcaatgacttgtccaatcatgagagtggggtattaaagtctctccctattattgtatggggttcaatatgagttttgagctttagtaaagtttctattatgaatgtaggtacctttgaatttgaggcatagttgttcagagttgagactttctattgatgaacatgaagtgtcctttctcatcttgcttgataacttttgttgaaagtctagtgtagtgcatattagaatctcaactcctgcttgtttcttggcaccatttgctttgaagattttttttcaggtcttttactatcaggtagtgtctgttattgaggtgtgattcttgtttgcagcaaaatgctgggttctgtttgcatatccagtctgttagtttatgccttttattgggaaattgagtctgtttatgtaaagatagataattgttaatttctgttatttttgttgttgtagatggcagtatgtttatgtaattctctccttttagttttgctgtgagactattaatttcttgttttagcttataatacatgaattgtttcttaatcattataaagggatcatttttatcttcagattaaaagttgcttaatgccatttttttcatgttgtggaatcttgatgccagctaatttgctagttccgtttgtttctgagaatgacatttatcattgcacactgagacagtgccaggcttttaggacaagatgtgtttcttggaaatcacaactggatgaaatctgtagggatggattggtagatagatattgttttaatttatttttcccttgaatattttgttttttccatctatgctgattgagagttttgctgggtatagtagcctgtgatggcatttgggttctcttagtgtctttatgacctctgtctaggcccttctggcttttagggtctctgttaagaagccgggtataattctaatggtttgccattatatgttacttggcttttcccctttacactcttttaatattctttctctgttctgtgcatttagagttttgattattatgtgacaagatgattttcttttcttgtccaatatttttggtgttctatatgcctcttgtacatttatggccacctctttctttaggatgtggaagtttacctttatgattttgttgaagatgttttggagtcctttgagcttggaatctttgctctcttctatttctgttattctaagatttggactgttcattgcatccttgatgtcctggatgtttggggtaagagttttttctgttttgaattttctttgaccatgttgtcaatatcttctaaggtattgtctatacctcagcttctttcttctatctcttgtattctgttggcgatgcttatatatgtattttttgacctttctcctaggttttccaattccagtgccatcttcgtttgtgttttcttcattatttctacttccacttttaggtcttgcacaactttgttcaattccttcacctatttgattgtgttttcctgtatttctttaacggatttatttgtttccactttttacctgtgtttacctatatttctttcagtgagtcatttatatccaccttaaaggactctataatttacattattgggattttaggtcaacatcttggtttccaggtgtgatgctgtttccagggtttgctgtggtgggagaactggattctgatgatgccaaagtatagtggtttctgttgcttatgttcttgttcttgcctctagccatctggttttctctggtgttagctgacctgggtgtctctctggaacgtgcctcctgtgtttctgagatgctgtaggtctcctgagagacctgtgaccctgtctatagcagtcctcctatatggcttcagactgtggggtcttcagagtggcagacaagctgctgatctgttgccctgcatgtagctgatctactggtttacctttcagctgtgggatcttcgggggagcagacacgctgatgatttgttaccatttgtgcaacagatctccttggaggccttcagactgttgggtctttaggggagcagtcaagctattgccctgggtatagctgttctcctggaagaccttcaaactattgggtcgtttgacctgtgtgcagcaagactcttgggagggctttaggctgttgagtcttcaaggagcagacaagctgatgatctgcctggcagaaggtgcaggctggaagggggggtggagcttgtggtgggtttggtgggagtgatggttacctagtctgctgaggttctcggggttcctaggtgctgcagttgtttgagaatgtttgttgtgtttgttgtgtttgttgtgttctgcctgcagcagaacacctgggaggcctttagactgtggagtctttagaggagcaaacaacctggtgttcaaattcaaaacttttagatatatgtagtgatatgtgtatagacaaatctgctacatgatcagagttttgtgtgccttgatagatatatgatatttatagcttgataaaaacatcaattatacagaaagatgacccatacaagagcaaattgatactacacataatgtaaagcttaagaaaaaaatccaagtagttatacagtaaaatcatggactttcaggatagctcagagattaagagcactgactgctccttcagaagttttgagttcaatttccagcaaccctatggtggctcacaactatctgtaatgagatctgataccctcttctcatgtgtctgaagatagcaactctggactcacatatttaaaataaagatatcttttaaaaagtgaaatcagaagtgttaaacaaagtgttttgtagtaaaaaagttaattaaaatagaaaaattactagctaattcataaactaagattttgtttcttatcaaaattataattacttattttagaggatattcatatctcagactgacctttaatgaattatatagcagagaataatcttttaacttttgatctccctaaccctactttaggagtattctgggattacagtcaaatattacaacaccaggtttatttggttccagcattcaaattcagagatttccccaggctggacaactgctaaatcaactgaactactatatctctagctaaaggtaaacttttatattttagagcttgttatcatgcagattcccatatttccaatattcaggaagttgatctagaaagatcacaagagtttcaggccattttaaactatgtaaccacatgacatagtgacttccacctttaatcccaatgttcagcatgctgaggttgaaggagcactgatgatttaaggacagtctggggtatatactgagttccagattaggcttggatacagagttagactatgtatagaaatagctataatagataaataaatacataaaaacacaatttgaatatttctttagatgttgtacatgtcagtcaacaactttctggctacattttttttaattacgtattttcctcaattacatttccaatgctatcccaaaagcctcctacacccccccactcccctacccacccagtcccattttttggccctggtgttcccctgtactggggcatataaagtttgcctgtccagtgggcctctctttccagtgatggccgactaggccatcttttgatacatatgcagctagagtcaagagctccggggtactggttagttcataatgttgcacctacagggttgcagatctctttagctccttggatactttctctagctcctccattgggggccctgtgatccatccaatagctgactgtgagcatcctcttctgtatttgttaggccccagcctagtctcacaagagacagcctatatcacagtccttgcaccaaacgcttgctagtgtatgcaatggtgtcatcgtttggaggctaattgtgggatggatccctggatatggcagtctcttgatggtccatccttttgtctcagctccaaactttgtctctgtaactccttccatgggtgattgtttccaattctaagaagggacaaagtgtccaaactttggtcttcgttcttcttcagtttcatgtgttttgcaaattgtaccttatatctcactatactaagtttctgggctaatatccacttatcagtgagtacatattatttgagttcttttgtgattgtgttacctcactcaggatgatgccctccaggtctatccatttgcctaggaatttcataaattcattctttttaatagctaagtagtactccattgtgtaaatgtaccacattttttgtatccattcctctgttgaggggcatctgggttctttccaggtcctggctattataaataaggctgctatgaacatagtggagcatgtgtccttcttaccagttgggacatcttctggatatattctggctacattctgagcatagtatgtgccaactttcgttcatcttttctactttcccaaaaggttttcaatataagaaataagttcaatacgttcatgtctccctggaaatttagatacaaggaggattatgcagttccaattttgatccaagaatagtctagactgcatccagaaagcatctctcaaaaatagatgattatagtctgtcatttccatgtcagaatgtttactatgtgtagacctaatttttcaaaaaagctgccatgcatcaatacctcagttgtattacttgtatatatttgtctaatattatattaaatctaatacatttataatatttgaggataaaatatatcctatttaaatttcattaaacatactgtctatcagattgtgaaatgattacagtcttaatagaagaaaggagtgcttcacactttgattcagtttctacatgaacattatataacttttgattcattatatttgtttgttatttctatagaatgtggtttttctctgatccaggagtagtgtggcccaactctactcctatctacttaaaagacaacacaggaggcctgcacatttgaggtcaccttgacaacactgaaacctcttcttcccatctcaacaataaaaaggtgatgctatctgcatagagcccataatcttttatctgtatactcagcaaatttaaaatttttaattatcaatatatgtttaaggataaacctgttataaatgaatagaaaaaaattaggtggcagaactgaaaggaagaactgaaaggagtatagatatatgtcaaaaaatgtactgggatattacatttgctacatgtaacatgaagtatttgaagtttaaatattaattccatgtgcatggttctatacactgctagccatattaggtagtacacaggtcttgaggtgaaaatagtttgctaatacatttttatttgatgaattaatacacccttcatgtactttaaaacatgctttaatttctttttactcacctcttttaacagcaaacaccaaataaacacctgctataggaaagatcatgaaggcatatattattatatttatttgtctacattgtttatagtaattacatagcaggaagtgtaggcacatgtctttaatcccaatactcttacagcattcttggatcactgagttcaaggcaaccctgggctacagagttccaagacacccaaaacaaccagtctcaataaaataaaacaaaatatttatgcctcaactgttcaattttttctttataaacgtacactgtggccaatatattgatcaactatattttagtaaaagtaattttgttattataggatagcatgtcatgagtttgatacttgaaataaaaacactttcttacccttagggatttacgcttttcagttgctgtgaataaactaccatgaccagtggaacttataatggcaataatttactgaggatttacagttcagagggttagtgcatgattattctggaatgaaacttggcagcaagcaggcaggcatggtactagagcagtagctgagatttgatatctgaatgcactagcaaaaatgcagagaggtatctcagaatgactaagagttttgaaacatagaagcctaccaccagtgacacaccttctccaaaaaggcatacatcccaatattttctaaacagttccaccaactgagcatgtaatggataaagttataattaactttaaattactctgcttgataaatctataaaatgtttctaacaagtaaagccccacttattcaaggacagataaattcttggaatgcttaaggctgttgtttatgcatgataacaagccatatgcttttttggttctataaacagtattggttttcccaactatacagcatatacttgatcacatgtaggcaggaggtagtgaggcagaaagtacatctagatgtatgctttcccctaattggacaaaggcaggaattgtacagtcttttgtgggttttacctttaaaattcctccataatgtatttttctgtgatatgctggccagtatttaataaagattgcttcagatttagctcaaaaattgtggtaaagctcttattcttgcccagtggaattatcacgaatcaagaattcaaatatgtgaacttacagacaccattcttgcttaaactcctgcattctctggcccacaaaagcttctggttatatgaaaattcaaaatttactcctacttcaaatcacttcatagactttgacagtgttaacacattaaaagtccaaagtttcatatgaaaatcaaggcattcttttaattataaagcttataaaattcaaaaagtatgttatatgcttccaatacacagttccagaaattgtttattatctttacagaagtagagaaatgaaagcatagtaagaaaatactggatcagagtaagagtgaaacccagcaaagtacatttcctataattccatgtcttataccacagtgcttacatgcctttctcttccaagttttgttgaataaagcatacttctttctcttggtctagtttcactccatgcctgcagccctgcttgacagacagcccatgactgttctggcacctttaatatcctgtggtctcactttcacagtttcacgccatggcctctcagaactgcagggactacagtaccttgagcctggcatcagttgctttccataacaaagaaggaagactctgaccaatttattcctgtattctccatgattctaaagccacaaccatatcttctacaaaacctacttcagctacttgcttgatataaagtctgacccattctttgaattatatttgcacacatttttatttgtttttgcttcctaggaatggaaaatttcttggcctttttctttcacaagttgcaggattagcttggtagaccctgggggtatcacaccctttattccattcctccatgactctccttaccttttcagtacaagccttagttccaatattaaatttttggtgttctttttctcttcacactatgtttttattttaattttttgtcttgcttgttttttctcattatagacctgtactagagtaatcactaataaccaagtgacagaacccatgctaggctgtcctgaaaactcttctagcaaagaaattaatctaattttgttttaatttagccacaggaagattcttttttttaaggtattttcttcatttacatttccaatgctatcccaaaagtcccccatgcccttccccccacccctctacccaccactcccacttcttggcccacaggaagattcttatgagaaagggaaaataaccaaattgattgccaaaataacatgagatggtatctagcctagttgctaatattgtttccactgtgtaagcttttgataaggctccatagctcacattgccttcagcactactatcttccaaatttctgctagaatggcttgttaaaccctgcttacagcatccaactgctttccaagtccaaagtcttaaatttttacatatactttcaaaacacagtgtgctaaggactatcatagcaatactttactcttggtaccaacttctgttttagttgcattttaatttctgtgacaaaacaccatgagtaaacctactttaaaataaaccattcattagggtcttagatggtgagaagcatggcagttggcagaagatattattcttcaaatcactgcaaaggttgtgcaagaagcttttaggacttcagatacaatagatatttattttctctctcttttttttcttccaatagagggagttcactataggttgcaagcaataagtaatctttctgctgttgactccctgatgttaggatttggatttttaaaaaaatatttccataataaattattgaatatagtacatattttaatctattagttgataggatatagaatctaaggatcctatattgaaaatactaggttaaaaaattaaagtgattaaatagcatataaaatatgtaaaataagaaataaatgaggaaaattatagcagtcatttttttatattatttgtcattgccttcagaactagatgctgcttcagtgaaattcttgtaaaatcttgaggatatttatttattggaaaactggtaacgttacttttttcacttaaagtctacttctatgtactctcctaggtggtgaatatcttcagatacacatcaaatatgcctttctgaaggtttcatctacagcatctcccaaataccattatatatttattgtttctggagtattattttacctttattatctcacaacttctatagaagatttccaaggaatagaaatgacctgctcttggcaagtaattgcccaaaatgttcaatacttctgttttgagtatatcttgaactctcatattgtttgttgcttattatcttttattcatattttaatttgcaaatgggagaaacttttctaagtgggttgcatagctaatgtatataaacatttttatgatacttcagattatagcaacattttctgactaattgaatctccctctatatcagttttgttatcgtttgtgagatatcttcttcctcctttgaataagaaactcagattttaggcaggccctaaagaagattgtttggtacagtggtgttctttagagaagatgctctggtgctatttttgctgatattatggtctctgtctagtggagcaatatgagtctctatggtttgctttttctccaatatgactactggagactttgatgcccttgtaactgagtgggttgagaaatgttgtccttgcactgataaggagagacatagtgatgctatattgtagaatgtgtggcatcatatttttttgatatcacttttcaggtgtgagtgaaatctcaatgtttcaaagtgatttttagttttctgtgtaatgtgggttttttatgttaatctccttaaactaagtaatgtgaagtagtgattattttcaatattagttgtgtgtttctagataagtcaccagttcatttgaaaacgactgcctttctcaactggttttaataattgtaagagtgaaaataattggtaagaattttaaagtgtctggatatatatgtctgtatgtgtgtatgtttgtgtcaggtgtctgtagaagtcagaaatgaaattcaggattatatactaattttattttgaatgcttgaattgtttccttacacattacttaataggtgtcagtaagaaggctcaatggaaaaagccaactgggaactccagttggatcactggaacccaggttatgtgtaagacagaatatagctgacaacagaacacttcacagattatttttaatctcataaatttgtagtacaatccatatcgccttactcattatattattattacattttagtgatatcctgaggtgcatcctggattctttttataatgctcatttattttgtatgcagtgttgtttttcttgttttaattgcaagattaaattagtgtatttcaattagtctttcatatttacattttctggggtcagattgcttatgattaatcagacaccactacaacttgtcagtttgtgttaagggccacaaaactttttaaaaacactagatttacagaccatatttttgaaactaggaatctgttcttgtagtacaagaacaattaaggctaatcattaaaccatgcccccagaaatagttgcaatacacaaatcttgggttatatttgtattttagcagatagttgtctaacctgtagtcagttgtgtaggtctagtttcatccagacaatctttggtagatttaggattagaaggtacagaaagagtatcttttcttgtacaagtttctgaatgctctacatgagtgattctcaacctatgggtcccaacccctttgtgggtcaaatacacctttgactaggatcacttaagaccattggaaagcacagatattttacattacaattcataacaatagaaaagcatagttatgaagtagcatcaaaaataatttgatggcaggaggtccctattatatgaagagatgtattaaaggactgtcatattaactattttaaaattagatgttttagttcattataatatcaacatctattgtgatcaaataattctgtggtcattaattgctaatctgctattccagttccatagcagcttatgataagggataaactttcatggtatatatacttgtcagtaactttcttatgtttatataaatgtacatggagattttagatggaagatctttgtattaatgatttttccatttaatctatcatcgtggtttatggagtttacaaaaatatgtttgctgctgcttgtgatgctgttgatgatgtgtataattatttaactatgataatatttttgagttcctgcttatataatagttttccaagtatggtaatattaaatcatcatctgtatatgtctttggtttctgtcaatattgtgaagttacctgcatatgttttctgggttaagccagagcagtggtgtaatatagtgctaattttcatagttttgtttatactaagtttcaatggctttgtacataacagccaatctaataggtgaaataatattttaaagcctaaattaagactaattttaaatgcttaatggccatgattttataaaactaaatagattttcagttgtagaagcaacgtaaagtttccaaattttgctaagtttacctagtgatacagcaaaggttgcatagtgataccttgtctcaatgtttgcattttttcataaattgcttaagtatacactatggtaacaagcttttctttatatttaattttgatgtaattatagaaccacatgcttttttatataatctgacttatgctctgcattcatttcacttattattcccattactctttccctctctagtcttctcatcttatttctgtttatacatgtcacagaactttgttttcatttaagatatgcagttcacactggccaaaatttttctgtggttattttataaccacataagtgtgcttatgttcctttaatcttggcttaaaatataagaaatgttgattgtcttgttgaactataatattaactatattataatatattataatgtaatatgttataatatattatagtattttggtaaggattatatgatattatatagttatcctctagattcccatttcttttctaataaaagaaagaaagaaaggggtggttacatttaagaaaaggagtggtgatgaaacataattagagggaggagaaatataattatcatatattttgtgagaaaatatctataaaagaaagcagaataaaatttaagaatatcagatgcactatgactagtttaaaagtatgtcatatgcattgctcatatttacatttcattagttggtttagtcgtgttttattctgtgggataaaacagaatttgcaaaagccatgtcgctttcatattacttaatttgaatcaaccctgtagactattttggttattcatagcattgaatttcttggaaataacaccttttagatttcaagagccctcagcttctgggtttttccttgtaaaaggatggcggacatatatttgtcatagaaaaacttcagaataaatgtgtgttatcttcaataaatcatgtcaagtctaaatgcttattgtcccaaaatggatgatcattagtttaattcaatgtgtcaactttctccaatgttgaagttctttctaaataaacattacatacaatgaccatttgaaaatatagatttctttttaatcaaactttaaccctatcaatttaaatgttccttgtgtttctatttttgaatactataagcaaatttgacagcacattttcagtgagcatctggtagaactcttgtatgaataaatctgagccagggctttttaaactttttgtttatttatttttatgtaatacattttgataacagttttccctcttctaaatcctcccatatctcttattatcagaaggctttattctactgtttctttaatagagtatttccagtttgttaagaagataactcttggttcaactttggtagattggaaaaattataaattcacccagttcttttagatctagattttaagttctgacataatggaacatatatttttaaagtgttcccttatattattatttttgactttttaaatgtttgttttgtttccttgatcatatctgattctagttatttaggccatcactttcttctttttgttaattgtgtccattaaatttgttcatcatttcaaaaattcagcttaatgattcattgacccattatatttttttcatgtttcattaatttctgctttatttttatactgtaaaattaaatatgtgtattttttaaatattatttttgcttttatttttcttacagtccattgtgacttattcatattttttcaggttcttgaactatatcacctagtcatttgtctgtgctatttttaggttgttttgtttttgtttttgttttgagatacgaccttaccatgttgctaggtgttacaaggttcttcaaaactgagttaacagccagacaggttagcacatacctgttatcttaatgtgtagaggcaaagaaaggaattccatgagattcatatataactgggatgtctagccatactatttattaaaaaataataaaaaccaaaacattaaaacctgggaaaatttgacatcacttactcattgctatattggataagattggtttattgattttgtgtgtgggtgtttgtgtgtgtatgtgtcagagagaaacaaacagagagagacagagagagagagaggaaaagagattttgagagactgctattatattaatcccttaacaaaaacttttaaagtaagaatttagctcctgatagtttagagagagaaataatagtttgtattaatcagtgtatgatttacttgtgatcataagcatatacaagatctagtgacagttgatataagaagaggaaaagctgcttgaagcactaccatggatactttagcatgaaggagttgagaaatcagtcattcctttgtatatcttcctcatgtcagtttccccttttattgttttgtctgcattgtagaatgtgaaagctcagtccttgattttccatatctactcattgaaaacaggaaaatctggtatatgtgaatattaaggtatattaagaataaatttcaaaggtaatgggatagtaattagatttttgtatggcaatgaaagacatagtttacaaatatagcttacatcactgttttatgtaaaagtgttgtgtagagaagggagaaaatggtcaagtttaaatctgagtatacctttgaatagatatattatcctttgatgatgtcatctgtatcatcatagcccagaaatatgctcacatattgcaaggttcttttaaaaagttacttagattttccatatagaacctttaggatctgggtggtggtggtcgtggcacatgtctttaatctgaacgctcgggagacaaaggcaggcagttgtttttttgttttgttttgttttgttttgttttgttttgttttgttttaagttcaaggccaacctagtctacagaatgacttcccatccatctgggattacatagagaaaccaggtctcacaaaaccaaaacaaccagcaaaacaataaaaaaaagaattaaacaactttgatagtgtttttcctcccattacttctcccagatagttcctacccttatctgccaaatgttatcacattcatctctgagtggatacaaaaatattagaatattacatgtgtactatttgacattttctttggcattccatgttggttgcataaatacattactgagtatatttaacatcacagcattataataataatcttttaatattctaaaactaatctaatatcattttattcccatttgcagtttcttttacttcttgcatgcattgaataatatttttgaggcatagtttttgcactgcttaaaaatatgtgttttttgaaaaatttaagatttattgagtaatagaatgaatgaaaggccaagcaaaatgaaaactaccaattttaataagtgaataaaggagtcaagatatatgatgctagaaatcaaggaagtagtgcagtatagaatgtacataaggaagaatttgatagaagtcctagtagggcaaggtgaattttgttcacattagtttatgatattattgctgaccgacagtaataagtagagttaggagaaagtacgtgtatggaagatattattgtcaagtgagccaagagaattgtgaaccttatttccaggaatgtattataaattattttctacttagtggcttataaatgagcacctatttttcaaagagtatcaatatttataccacataatatatgatttatatctcaaaaatttctttttcattcatttatctttcatttatttactttttttagaagactaaaaattttgagctcttaattacaaattaatagtcatttaactctggaaatataaatcacatattctgcttattatcctcttttatatttgctatttggtccctaccaaaggagtcgttctagccctatttatactcttgtattttaaatattttcttttgggagctattgtagaaaggctagaaatgaatcattggtaagacaatgcaggacgcaatgtcaccaagaatactgttttttaaatctttagagcaaacactgtagtttaacttctatgtctaacttcaggtactttattcatgtgtcacttggtcctatctttttattgcaattcttgacctaaactgttttaaaatttttagttgagttttaattatgattatttgtatctatgtgtgggtatgtgtgtgaaaatacatgtgcttctggagaccagaagagggtatcagggcacctgaatctggaatacagttagtacagggaagctgtgagctggccaacaatggtgctgggaacttatgtcatgtgctctataaaagaaatgctctaatctactaacacacatccctaaccctgacataagtttttaagcttatttgtcaaggtctctcacattccatggtaggcatttccttaaagtactttattttcatttcactttctgagcaagttcatgtgtttagtattgaaattcaaccagtactacacatctactgatgtatgacagatgagaatatacttagtaggttatcatgacacatgcttttaattccagcactgcagagccaggcatatctctatgagtttgagtccaatcaaatcaacataatgagtttctgtctatctcaaaacaacaaaacaaaacaaaacaaaacaaaacaaaacaaaacaaaacaaaacaaaacaaaatactccccccaaacagcaactagtgtgttataagttagataccatttgtcttagtttggattttgttgctatgacgagacactatgaacaaggcaactcttataaaaatacagtggggctggcttagcatttcagaggtttagttctttgtcattatggtttgaagcatagctgcatgcagctaaatatgctgaaggagtcaagagttctacatcttgatctgaaggtagcaggagattgtgtgctacactggatgtagcttgagcattggagactttacaggctgccgcacagttacacactttccagcagtgccacacccactccaacaaggccatacattgttggccaccctctatggcccaatcattcaaacatgaatctatggtggccacaattgttcaaatgaacataccatatgacaaagaaaaaaaagggttgtttgttcaaaagagaagggatattcttctttttggaaagttttaaagagtctagaaacagcaagatgccacacaagcagtatctaacaaatctggtactattatatgcattgagtttattgctgtcttatgaactattctaagtaaaattaacattttactaatattacatttgtaaaacttgattcttttagttcaattttgaatagtaccagatttactaaaacatttcacattcatttatgattatcttcattgataatattttgtgggatcccacacatgtccttcttatatctagtgttgaaattttttttataaacatactttttttaaagatttatttatttattatatgtaagtacactgtagttgtcttcagacactccagaagagggcgtcagatcttgttacagatggttatgagccaccatgtggttgttgggaatttgaactcaggacctttggaagagcagtcagtgctcttaactgctaagccatctcaccagcccctgaaatttttgtttggggatattttgctggttttgtatatttgggtgtgatttattgaacaacagtgagatataaaatacaggaaagatcaagatgccttaaataattgtaggtatttagtcatttcttcatttttactccgtacttcaagtttttaaacattcatgtttacatgtagtattttgtcccctttcttcaaaagaaattcagtgagctcctacttgacaggaatcattttctttctattatcttacagtgtcgtttccaaaggagagattttgcttaaagtttacaaaataaaatgataaaggaaggagtgaaaaaaaaactttgtgaattatactataatacatttgtaaaaagcaaaattatgttttgttagaaatgctattatgaaaaatgtaattatagtcatttagtagtatgcatgtttgataggatttcgaggaacttgtaaatcatagtggtttttttttcctcttcagttttatttctgtatttgttcagtgaattggtgtctaattcttacttgtttacaactacatctttcccaacccttctaagtcgtagtagagaattttgagagttgatcacagaagacactttaggtttttctccagatttatgaggttgtcagggaaaaatttctgggaattttgtgaaacaatgaaagtgaaggggtattcttgctgcttccattgatgcttaaaataattgtgagacacctgaatgactagttttagaacttagatcttagtaaaaatttaatgtttctgatatttctcaatttgtaaatatacttaaatactaattcattgtttactgaaagacagcgtccattatgatatttcaggtgatataattcatccttattctctcatacccactctgcctttcccttatgtatcatacactggccttgtagcccacatttaaattgttgtcttccctcccaactgctgagattccaaatgtatgccagtatgcttgactttaagatttttgggtataattatgtttaattatatttaatattttttctgtaagattgtctaggtcacactatgtagacctgtctggcatcagattctctctgtagaccaagttgattatcagactcagaaatgtgtctgcctctgcttccaaatactagccttgcaagcaggtaccaccaatcagctttcatttatcctaatatgcccctgtaaaattcactattgaaacataagattatggttaaattttctatagctttctttaaaggtaattgctgcttatagaattttgttaacactgattgaaagtctgagaacatttgaatatttgttcttcataacattttcctccaatttaagacattcatagctagttatttattgcaaaatacttgttcacgtcatgttccttcatgtgattttcttctcattttttggatgatgaatttcagtatagtttaggatgagcatgaatctttggaatgtagtccctgcttatgtggcttttgtgaaatactataggtaaaatgtaataatttctttgtttgagtagttggcttagcacttagtagtaagtgaagttttacatgttaaaacagagtatgaggttttagcaaagtaaatgagttactatttaattacaaaaatccatgaactagtttctgtgattgtttctttttaaaaatatttttattaggtattttcctcatttacatttccaatgctatcccaaaagtcccccataccctcccccccactcccttacccacccacacccacttttggccctggcattcccctgtactggggcatataaagcttgcaagtccaatgggcctctctttccaatgatggccgactaggtcactgtgattgtttcttatttcctttatgattttagagaaatgagctccattgacagggaattagttttatagagacttattttgagaacttattacatgacaacctttttctccttctttctttctttctttctttctttctttctttctttctttctttctttctttctttctttcttctctctctctctctctttccctccctccctccttccctctcttcctcccttcccttccctccctccctccctccctccctccctccctccctccttccctccttccttccttccttccttccttccttccttccttccttccttcctccctctctttcaccccaaatctgtagttctccccacaacccaccccgacaaatctcttgacccattaccttgcccttcttctcatagaaggggaagtctgtttttttccccaccttggatatgaagtcaaaacagagacagggcaatccacccacttgagttgttggggtacccacttgaagtccaagcggcatgtctgcagcatgtgtgtgtgtgcggggaggcagaggaataaattcagcctctttggttggtggttcagtctctgaatgttccatgttagttaactctgttggtcaattttgtggattctctactcactctgggttcctcaatcctcacaactcttccacaagactttgtgaaccccacctaatctttagctgtgggtctctgcattgtttctgttagcttctgggggagactctgatagtacagttttgctaggctcctctcgataagcataacagtatcatttatagtgttagggatttttttcttgcctatgtgatatagctcaagttgtgccagttattggttggccaccacatttgctctttgaagttcctaattgaatgggcattatctttttttatatttttctattcatcacatttatatgtaagtcttgtttcttagcaatattgtttttatatgtatcacttgaacaatgattaacacacgttgtaacaaaatgactactgaaaagggtaatatttagcctattaaatttagactaaacaatatatgcaaccaatgtgtcatattcattctaattatattctattttagacatttccttatttctatgttgtgtggctctaaaggttaatgctagagtattctagaattattaatttaagattaacttgtaaataagtcttatttttccatcaattatgtattcaaaatatacttagcatattttgtgaaaggttcatttaaatcaaccggaaaagtaagaatgataggaaaatgtgagaaagtacatacatgaatgattcaaaaatgtgttataaatggccacaaatataaaaatatattcaattatgtacatttttttactaaaggattaactgtcatataaaataagatcagaattataaaagatatattaagaaatgaattttcttttttcacctatgagattcgatgaaatatttgcaaacaaaatttaaagcaatttaaattccagataatattgaaaaactaattaagatagagatatatgatgaaaattagcatattttatcactatttcacttttagaaaatcacttatagtatgtaatttgaagtttaaaatatgtgaagcattaagagtactcatcatagtgaataattatgtttgttattattgatatatatgtatcaatcataattttaattaagtaattgatttatgtctagtgattatgataatgtatgttcaaattagctggcaaaggtcccagattgaaaagttcattcatttttgctgagaaccatttatgtctgaaacattgatgtatatatccatatcaaatgttatatgcatatgcttctctatgtggtaaataaaccaattttatcaaatggatattttaaattattcataatgatttcttgtcattattttcctcatatttatatttttgtgttgtaattttcttcgcataaaaagaagatggagcacaaatgctcagtagataaagctacttgttaccaagactgacaaactaagttttacttacactcccacccaccccacccaccccaacatactcacaaatagaataacattttaaaaatgaagtagggacatcactatttgactctattgcttctttcctcttttttttttttgtatttcacattcttcctccacttgtattatttttttttatattaagtctcttattatggagttctgaaatatttgaagacttaattgaacagatgtaaataccataaacatatcctgcaatgtgtttttgtccaattgtaactcattatcttatgttcagattttacataagctaatcaatgaaatatatgttctatgatgatagaacatatcatcttcacctttcatttcttattcacttgaaccctttttcatttttaagttaaaacttaactgtaaagaacttgctgataacttacttctatagtccttaaggaccttttcctcatgaaatctgtaactccacttaatattgtatattttacatatattttctacaaattttctgatttaatttttcttaaaacctgaatagttatattatgaaccttaacagatttaccaaatgttcattgttgcttcattcactagttttgctccacttctttggtcaaataccattttctatgatagcgtgtggcattctctaggtatatacctaggagataaatagctgggacaaatgttagctacatctttaattctcttttgtggaaggttaaaagtagacccttgaatgtaggacagtttacaaaagaaacatgaatggtcaataactattttaaaagtatgcaatatccatacccatcaggggaatgcaaactagaagtaccttgggacactagagtacatcagtacaaattgatgtcatgaagcaatatgaaaggatatggagaagaatgttatacactgaagatagtattgcaaattaataccgttatggaaattagttattttccaacacttccaactagactttttttttaattaggtattttcttaatttacatttccaatactatcacaaaagtacccccataccttcccctccactcccctcctcccccactcccaattcttggccctggtgttcccctgtactggtgggcctctctttccaatgatggcctactaggccatcttctgatacctatgcagctagaaacacgagctctgtggggtgggggtactggttagttcatattgttgttccacctatagggttgcagacccctttagctccttgggtactttctctagctcctccattgggggccctgtgatccttccaatagctgactgtgagcatctacttctgtgtttgctaggccctggcatagccttacaagagacagctatatctgggtcctttcagcaaaaccttgctagtgtgtgtaatggtgtcagcatttggaggtaaaatgtggacacttttccctttcttagaattgggaacaaaacacccatagaaggagttacagagacaaagtttggagctgagacgaaaggatggaccatctagagactgccatacccggggatccaactatactttttgtcttatatgtacagccacggtggaattcactctggaattttatagtcactgaagaactatcattgctttgtacatacttcatgaatgcacacagctgccccttgtgaagggatcctctttagatagatctctggaaaagttacagatttctgtttctgtcattgtagtctttgtatcctgttgtgcgtctttcatggcattgtcagccccaaaacctgagtaggcagaacattgacagtcatatagtagctctgaaggtaaaggcctggcttacagagccctttgattgtactgaggacctatcaggcagactattagcaggaaaatactccttctctatatttttagttccatttccaataccttcctaacttctctttccctaggtttatattggaagaactgagtattaatatgatttaccctgaaaaatagaggcagtgtaggtggaaacacgcagtcctcagtgacttggtcagtggaggaagtgcttcttgtcaaacaaggtgtagttgaagatatcccagagatatcatcacatgaatattaaaacaccatgttcaatttagtggtccagaaggggcattgtctgtgccaaaatgtattgagaagttgaagactcagaagtctacaggtgtggggagacaccatagacaagaaaacttttatgaagttaatggattgcagtcttctcagatggatgaattgtgcattgattacaaaaatggaaaggagacaggcaaacatatcgacagacaaagatagagacagagagacacagagagagacaaagagacagcagggagatagaaacatttctagtgtctcataaacctagatggtatgaagaatattgatagggaggtagaagtgctactagtgtatcaggctgaccattctctataaaacaaggtagaaaaatgttcacccatttggagataatgacgacatggaggaatactatttgaaggtgatgttttggatattttcattatgggaaatgcctagcttcagggctagcactggtcagtgaaacccaataaacttgtccttggaaattccattaatgaatgaatattgaataggagagacattgtcagacgatgatcactgatgaaaatttaatactcatttgtgttggttggaagtatttgatgtattagaagccttaggattttgtcagtgactactgtcaaaaaagataaaagacatttcttctggctagacagagagaccactggagagcaagaccttgagactaaaccacttccatctgcagagacccttgggaaaaatactgacattgcagtctgataaaatggtgtagagagatcatgggaaggaaaggaataggtttacctggtgttcccagtcagactggagtggtgcaatgccacaatgtatccctctgtagagattgtatatgcttatattttcacctcaaaattttactcccatgagtcataccttcagtccaataagaggaagaaccaatcatttatgaatggagaaaggcacctaatagtgtctcatgaaatatggtccaaggtgcaggtaccacagaagaaagtagaggatactggtaagcattattttaatttctcaaagtcttcatgactcttaaggtttttctagaagtattatgacctaaaattgcacaaacttgtgaaatcctaccatctctcacatttaaagtttctgacagttactactttggaaaagtggaaggtcttaattttcaacatacttatcatatttctgcaattttaagagtataccgaccacctgattgcaagcacccaacaattgctacttggccaaaatggtattttccagtcaaacatttatttgtaagtgcctaaccaaataagtgattactcattatcaccattataatcatgactaaaatgcagcacattcactcatctaagtactgtacaagtcatacatatatttctaagtcattgcactgcccttgctgaccaccagatttggcaaagtcaccttacagaagggcccaagtttttacatttcttgataaacagacatgtttgtagtgagcataatttgggtacttaggaatctccctgtggtaatgtttctatgtaggcaaaagtggcaagaaataagataacatagtcacagacacaaacagcagatgcatagttacctaccatctaaaaatacatattttctgtgtggagattttaccaggcttgagtttgttagttaccatgaagtagtgtgtcaaagaaatgcattgaaataagactctgtcttagaatttgcttcattggggatattattagtgtaatccatattcatgtgctacatctgccttggtaataaataggaaaagtgtgggtccctgaatgtcagaacatgatttgcaatccacagttgaaaagagagcaagagaccatgtctgaagctgttaaaggctggaggtactctgctgtgggacatggaatctttggcccgttgtgttgagtgattttttatcagatggccaaaacagtcctgtgatgaaataggctgtttgtgttgttgacaagctgaaaatagttaggtggacctgcttagaaagagagcaagggacacatgtgttagtcatggaaggcatccatatccatgtttgtttccctgacttacacccatacatgtgcacctagaatttagtcttgaatttcagagtaaacaggtaaaaatattaagatctgtgaatgtctgtatgatataagtgtatcaagctgtatagaaataatatcgaccatataaataatatagataatatatcgacttaacatagtcacgatagttccctggaaatgtttgggtcaccaaagtggcttccactaggaatctagcaaaacaaagatatgagagtgatgggtatgggctttctattaaattgtgacagtacatgtcttgaacaagccttaaaaatgttgatggttgccacagtgaggctacctaataatgtggacctcagaatagtgacatgtctatgttttcatatttataggccttgtacatatttctgttttgttctgagcctttttatcatggagagtacatgagggttgccagagttgacagagaatgtcaacaatagctgctgagttccagctatttggaatttatcactccttttgcatatttaaaacttgaaggcaagatttgggccaaagaatgggactgatctgtattttctatcacacccacagtgtgccaggggggtctcttttgggtctgaatgaactttataagaaaaatggcaacatattgtattatgaactgaagttttggtgatatgtctcagaagggttgtttggtctccagtttggtggccaattgaaaaattacctagtgaaacatattggtagatagatacagagaaagacagaaagaggccaatataaacaaatacaaagagagtggagtttggttcatattgccttagaaagtatgtcacttactgctggaaaactggaaggacaataggataaaaatttggaaacactggtctaaagcttctcagcatgtattaggaatgaagacttcgtaggagtgcctgtggtctttctacacatataggtaagtgtttggagttacttgatgtcttctatgtcctgggattagttttgttactgcagatatgtacagaggtcatcctgaaggcaaggaagggagacagggtaacaccagtttgcatttggccctttataattgaggtatgtgctttgatctgtcttctcaaggtcacattctgtggtgcccatagacacagtgaagagatacatggtcaacatctttggatgagggatgagaatattagaataagactccagaaaagttgcttggtatgtctgtcttacctgaggaccaatggagtttaaaggtaagatgtatttgaatttctccaattgctaatgattctagcatttttgctgaaactgcaaggatgtaccataactttatccactcctgtcaggacctacagcacttttagtgactttgaaagctttttttcattttctgtcagttttagtaactatgaaagtcccttgatgatgaaagttttggaattttcatactcagtgatgtatacactctgcatagtaccttgaaaagctttgtgaaggggtactatagtgtgtcttgatcaatgatgattctcaaagattctctggaaagctgaacaaaatgattgattacttaatagcaccactctcttctggactgagatttatcacattgaatcacccacatcccctggagtcatataggcttataatcctctatactttgtgtcctcttttatttatatcagataccttgatgagagaccaatctttttaggactctgctatcatgtgtagtattcatgaaaacaacccatatagggtttgctggtaacatccccatgctcttggtgaggtacattctcaagaaagaaatggtagtgttggtagcttctaggagtggcctgcaggcagagatcagatctgaatcataaataggagtagcagtgcccccaaagcttgaatctacactcaggggattctaggccttgtgtgtagtcttcttagaaaccttgaagtttattggagccctgcagtgctgcttcagagaaagacactctaatcaaggatacaggagtaatttgcactggtgctaaattcttaaagcctgagtgagtgtgtatgagtgtgtgtgtgtgtgtgtgtttgtgtgtgtgtatgtgtgtgtgagtaagagagagacagagagagacagagagatagagagacagagagacagagagacagagacagagagggagggaggaagagagagagagggagaaagagagagagagagtgagagagagagagagagagagagagagagagagagagagagagagagagagagagagtttaatgttggtaagttcctttgtagctgagtaggcagactgtggtgctgaccaccaggatgtttttccatgcaccctgcttgggaagagagcaagagtaattctgtgtgttcctaaggtatgtttggttgctatgtataggttcattagaagatgggccaaatgacacacaagctgccacagattcaagactaggcttgaacattaccacatggtcattgacatctttaagaagatcctgtccttgaatttggctcttgtggcaataagaaatgttgagtgtttcagcatctttttgaagtttcttgacttctagtgatcattcaaacaggtttgaccaattttttcaatgtcagagagagtattagtgtgtgtgtgtgtgtgctcgtgtgtgtgtgtgtgtgtgtgtgtgtgtgtaagagagagacagagacagagacagaaatacatagagacagagagacagagagacagagacagacaaagaaacagaggcaaagagagacacacagagaaagacagatagaggaagtgacagagacagagcagaatgacaggaacagaaagagagcagattgttgttgacaaattgatctagacaatcttctcattactgttgggtgaaatgtaagagtaagctgttgagcaggttaaccatttccctttactaggacagagtttttaacacaacaatagcaaatcagaagtcagaagcccaagtaatgtgaagagctgttcatgaaggtatggttttactggtgaacatggccagtgttgatttctagctcctagctggtagatattgagaagagatctcccttaatagtgtactaagttgtcagtgttttctgggaggacttttttttcttgtatctttaattttttgtattctcttatatattacatcctgtccgcagtttcctctcaccctgtgccccaaactcccccttttccacccttctccacaaaatccccctctgctgcccttagataatactagacttctgtcttagtcagagtttcaattcctgcacaaacatcatgaccaagaaacaagttggggaggaaagggtttattcggcttaaacttccatactgctgttcatcaccaaggaagtcaagactggaactcaagcaggtcgagaagaaggagctgatggagaggccatggagggatgttccttactggcttgcttcccctggcttgctcagcctgctctcttatagaacccaagactaccatcccagagatggtcctacctacaaggggcctttcccctttgatcactaattgagaaaataccttacagttggatctaaatgcctccaggcatttcctcaactgaagttcctttgtctgtgataactccagctgtgccaagttgacacaaaactagccagtacagctttcctggggtatcaaccaaatgtgatttaagaagctataataagaccaggtacataccaatacatcaatgctagaaaggcaacccagtaaaggggaaagggtcctacaaggagggaaatgtgtcagggacagctcctgctctcatgatttgtgtttccacaagactacccatggcatacattagaggacctaggtgagatagcttcaagttcctgtcctttaagatcccataagtcctggtccattgattctatggggtgtaatctcttagtctatcccctgatcctcctaatttttcaaatccttatcagtgggactccgcaagatctgcctaatgtttggttgtggtacactccaatcagttgctgcatgaaatctctctggtctccttgatcctttttctactatgcactggtctcatcatattcttgaggaaggacaaaccagaggctgaatcttttgtgaccatgttgatgtctcagtcacccacatttaggtcttacctttttaagaagaggccagatcaggccttgtgtctctcattactaggagtctatgctaaggttatggtaatagatttcacagaatttccattgcactacatttccatattgaaatgcccccagtttagtttttttctagtattttctcatgccctcgcccctaccataattcctcttcctagtctcacccatacagaatcgacctggaaaattttttatttcaccttttcatgaagattctttttttaaaaaatatttttattaggtattttcctcatttacatttccaatgctatcccaaaagttcccccataccctctccactactcccctacccacccactcccacttattggccctggcgttcccctgtactggggcatataaagtttgcaactccaatgggcctctctttccattgatggccgactcggccatcttttgatacatatacagctagaatcaagagctccagggtactggttagttcataatgttgttccacctatagggttgcagatccctttatctccttgggtattttctctagctcctacattgggggccctgtgatccatccaatagctgactgtgagcatccacttctgtgtttgctaggccccagcatagtctcacaagggactattttgttcatttccatcacctgtttggttgtgttttcctgcaattctttaagcgatttttgtgcttcctctttaaggtcttctacctgtttagcagtgttctcctgtatttctttgagtgagttattaaagtccttcttgatgtcctctaccatcatcatgagatatgcttttaaatcccagtctagcttttcgggtgtgttggggtgccctggactggttgaggtgggagttttgggttctgatgatggtgagtggtcttggtttctattagtaagattcttatgtttacctttcgccatctggtaatctctggagttagttgatttcgttgtctctgattacagattgttcctttcatgattttgttagcctctatcagcaatcctgggagactagctctctcctctgagtttcagtggtcagagcactctctgcaggcaagctctcctcttacaaggaagatgcacagatatctggctgttggacctccctcctggctgaagatgaaggcccaaaacaggacctgtaccagaagctgtgttgctttggcctgtcccagaagctgttagcttctgtagtccatactctcacctgtgcagactactctctgcggagtcctggaaccaagatgtctgctgccaatgctcagccaaagccctcctgggctggtcagacacctatcatctggccgggaaggtgcctggatgtctggggcctgaaaagcgggctgcctcagaagctctgtgactcctgcctgtcccagaagctgttagcttctgtggtacaaactctcacgtgtccagactattctgggctgagtcctggaaccaagatgtctcgcatgtgtccttaccggcttgaacatcatctagatatatgtccaggagatgtatttcaggaacctctaatagcactatgtccaatttttttgaggaaccacctgactgatttccagagtggttgtacaagcttgcaatcccaccaacaatggaggaatgttcctctttctccacatcttcaacagcatctgctgtcacctgaattttttatcatagccattctaactggtgaggaggcaactcagggttgttttgattttcatttccctgatgattaaggatgatgaacattctttcaggtgcttctctgccattcagtattcctaaggtgagaattcttttttcagctctgagccccatttttaatggggttatttgattttctggagtctaccttcttgagttctttatatatgttggatattagtcccccatttgagttaggatatgtaaagattctttcccaatctgttggtggtgtttttgtcttattggctgtgtcttttgccttgcagaaactttgcattttatgaggtcccatgtgtcgattctcgatcttacagcacaagccagccattgctattctattcaggaatttttcccctgtgcccatatttttgaggctttcccccaccttatcctctatatgtttcagtgtctctggttttatgtggagctcctttatccacttagatttgaccttagtacaaggagataggaatggatcaattcacattcttctgcatgataactgccggttgtgtcagcaccatttgttgaaaatgctgtcttttttccactggatggttttagctcccttgccaaagatcaagtgaccataggtgtgtgggttcatttatgggtcttcaattctactccgttagtctacttctctgtctctataccagtaccatgcagtttttatcacaattgctctgtagtacagctttaggtcatgcatggtgtctccatcagagattcttttatccttgagaagagttttagctatcctatggtttttctttttcttttttttttattccagatgaatatggagattgccctttccaattcgttgaagaactgaactggaattttgatggggattgcattgaatctgtagatttcttttggcaagatagccatttttactaaattgatcctgcatatccatgatcatgggagatctttccgtcttctgagatcttctttcatttctttcttcagagaattgaagttcttatcatacagatcatccatgtccttagttaggttcaagtcaaggtattttatattatttgtgactattgagaagggtgttgtttccctaatttctttctcagcctgtttatcctttgtgtagagaaaggccattgatatgtttgaggtaactttatatccagatacttcatttaacttgtttatcaggtttaggagtcctctggtggaatttttagggtcacttatataaactatcatatcatctgcaaaaagtgatattttgacttcttcctttccaatttgtatccccttgatctccttttgttgtcaaattactcttgctaggactaaaagtacaatgttgaataggtagtgagaaagtgtgcagccttgtctagtccctgattttagtgggattgcttccagcttgtcaccatttactttgatgttggctactggtttgctgtagattgcttttatcatttttagttatgggccttgaatttgtgatctttacaagacttttatcatgaatgggtgttggagtttgtcaaatgctttctcagcatctaaagagatgatcatgtttttttttttttttttttttttttactttgagtctgtttatataatggattatgttgacggatttctgtatattaaacaaaccctgcatcccttgaatgcaacttagttggtcaggttagatgattgttttgatgtgttctcagatttggttagcgagaattttattgaggatttttgcttcgatattcataagggaaatttgtctgaagttctctatctttgtttggtctttctgtggtttaggtatcagagtaattgtggcttcattgaatgagttgagtagagtaccttctgcttctattttgtggaatagtttgtgaagaactggaattagatcttccttgaaggtctgatggaactctgcactaaacccatctggtcctgggctttttttggttcagagactactaatgactgcttctatttctttaggggatataggactgtctagatcattaacctgatcctgatttaactttggtacctggtatctgtctagaaatttgtccatttcatccaggttctccagttttattgagtatagccttttgtagaaggatctgatggtgttttggatttcttcaagatctgttgttaagtctcccttttaatttctgagtttgttaattaggatgatgtccctgtgccctttagtgagtctggctaagggttcatctatcttgttgattttcttaaagaaccagctcctcatttggttgattctttgaatagttcttcttgtttccacttggttgattttgtccctgagtttgattatttcttgccatttactcctcttgggtcaatttgctttcttttgttctagagcttttaggtgtgttgtcaagctgctaatgtgtgctctctctagtttctttttggaggcactcagagctatgagttttcctcttagaaatgctttcattatgtcccataggtttgggtatgttgtagcttcattttcattaaactctaaaaagtccctaattcctttctttattcctttcttgaccaaggtatcattgagaagagtgttgttcagtttccaggtgaatgttggctttctaatatttatgttgttattgaagattagccttagtacatgttgatcttaaaggatgcacgggacaatttcaatatttttgtatctgttgaggcttgttttgtgaccatatggtcagttttggagaagataccatgaagtgctgagaagaaggtatatccttttgttttaggataaaatatttgtagatatctgttagatccatttgtttcataactccttttagtttcactgtatctctgtttagtttccgtttccatgatctgtacattgatgaaagtggtgtgttgaagtctcccactagtattctgttaggtgcaatgtgtgttttgagctttactaatgtttctgtaatgaatgcgactgcccttgtatttggagcatagatattcagaattgagagttcccttggaagattttacctttgatgagaatgaagtgcccctccttgtcttttttgatgactttggcttggaagtcgattttattagatattagaatggctacttcggcttgtttattcagacaatttgcttggaaaattgttttccagtctttcattctgaggtagggtctgtctttttccctaagatgggtttcctgtaagcagcagaatgttgggtcctgtttgtgtagccagtctgttattctatgtctatgtaattgttgcttcctattatttttgttgttaaagttggcattctgttcttggggctgtcgtctttttttttttttttttttttttttttttttttttttttttttaggtttcttgaaggattactttcttgctttttctaggacatggtttccatttttgtaatttttttctgttatcctttaaagggctggacttgtggaaagataatgtgtgaatttgttttgttgtggaatactttgttttctccatctatggtaggtaattaaaagtttggctgggtatagtagcctgggctggcatttgtgttctcttagtgtcagtataacatctgtgcaggatattctggctttcatagtctctggtgaaaaatctggtgtaatactgataggtctgcctttatatgttacttgacctttttcccttactgcttttaatattctatctttatttagtgcatttgttgttctgatgattatgtgtcgggaggaatttcttttctggtccagtctatttggagttctgtaggcttcttgtatgttcatgggcatctttttctctaggcttgggaagttttcttctataattttgttgaggttatttgctggccctttaagttgaaaatcttcattctcatcaattcctattatccgtaggtttggtcttctcattgtgtcctggatttcctggatgttttgagttaggatctttttgcattttccattttctttgattgttgtgctgatgttctttatggaatcttctgcacctgagattctctctttcatctgttgtattctgttgctgatgctcgcatctatgtttcaagatttctttcctaggatttctatctccagtgttgcctcactttgtgttttctttattgtgtccacttcccttttaggtctaatatggttttgttcatctccatcacctgtttggaagtgttttcctctttttctttaaggacttgtaattctttagcagtactctcctgtatttctttaagtgagttattaaagtccttcttgatgtcctctgccatcatcacgagatatgcctttaaatctcggtctagcttttagggtgtgttaaggtacccaggactggttgaggtgggagtgctgggttctaatgatggtgagttgtcttggtttttgttggtaagattctttttttttccatttttattaggtatttagctcatttacatttccaatgctataccaaaagtcccccatacccacccacccccactccactacccacccacaccccctttttggccctggcgttcccctgtactggggcatataaagtttgcgtgtccaatgggcctctctttccagtgatggccgactaggccatcctttgatacatatgcagctagagtcaagagctccggggtactggttagttcataatgttgttccacctatagggttgcagatccctttatctccttgggtactttctctagctcctccattgggagccctgtgatccatccgttagctgactgtgagcatccacttctgtgtttgctaggccccggcatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgcaactccttccatgggtgttttgttcccacttctaaggaagggcatagtgcccacacttcagtcttcatttttcttgagtttcatatgtttaggaatttgtatcttatatcttgggtatcctaggttttgggctagtatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaatatggctgctatgaacatagtggagcatgtgtccttcttaccagttggggcatcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatccacatcagcatctgctgtcacctgaatttttgatcttagccattctgactggtgtgaagttgaatctcggggttgttttgatttgcattttcctgatgattaaggatgttgaacattttttttttcaggtgcttctctgccattcggtattcctcaggtgagaattctttgttcagttctgagccccattttttaatggggttatttgattttctgaaggccaccttattgagttctttatatatgttggatatatattagtcccctatctgatttaggataggtaaagatcctttcccaatctgttggtggtctttttgtctcattaacagtgtcttttgccttgcagaaaatttggagtttcattaggtcccatttgtcaattcttgatcttaaagcacaagccattactgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgttgtctttcttccactggatggttttagctcccttgtcgaagatcaagtgaccataggtgtgtgggttcatttttgggtcttcaattctgttccatttgtctacttgtctgtcactataccagtaccatgaagtttttatcacaattgctttgtagtaaagctttaggtcaggcatggtgattccaccagaagttcttttatccttgagaagagtttttgctatcctcgtttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagacttgaagtttttatcatacagatctttcacttccttagttagagtcacgccgagatattttatattatttgtgactattgagaagggtgttgtttccctaatttctttctcagcctgtttattctttgtatagagaaaggccattgacttgtttgagttaattttatatccagctacttcaccgaagctgtttatcaggtttaggagttctctggtggaatttttagggtcacttatatatactatcatatcatctgcaaaaagtgatattttgacttcatcttttccaatttgtatccccttgatctccttttgttgtcgaattgctctggcgaatacttcacgtcctatgttgaaaaggtatggagaaagttggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgttttttagtttgtttatatactggtttacattgatggatttccatatattaaaccatccctgcatccctggaataaaacctacttggtcaggatggatgattgctttaatgtgttcttggattcggttagtgagaattttattgaggatttttgcattgatattcataagagaaattggtctgaagttctctatctttgttggatctttctgtggtttaggtatcagagtaatagtggcttcataaaatgagttgggtagagtaccttcttcttctatcttgtgaaaaagtttgtgcagaactggaattagatcttctttgaaggtctgatagaactctgcactaaacccgtctggtcctgggctttttttggctgggagactattaataactgcttctatttctttaggggatatgggactgttaagaaggttaacttgatcctgattctactttggtacctggtatctgtccagaaatttgtccattttgtccaggttttccagttttgttgagtatagccttttgtagaaggatctgatggtgttttggatttcttcaggatctgttgttatgtctcccttttcagttttgattttgttaattaggattttgtccctgggccctctagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgttctctcccgtttcttcttggaggcactcagagctatgagtttccctcttagaaatgctttcattgtgtcccataggtttgggtatgttgtggcttcattttcattaaactctaaaaagtctttaatttctttctttattccttccttgaccaaggtatcattgagaagagtgttgttcagtttccacgtgaatgttggctttccattatttatgttgttattgaagatcagtcttaggccatggtggtctgatagaatacatgggacaatttcaatatttttgtatctgttgaggcctgttttgtgaccaattttatggtcgattttggagaaggtcccgtgaggtgctgagaagaaggtatatccttttgttttaggataaaatggtctgtagatatctgtcaggtccatttgtttcataacttctgttagtttcactgtgtacctgtttagtttctgtttccacgatctgtccattgataaaagtggtgtgttgaagtctcccactattattgtgtgaggcgcaatgtgtgctttgagctttactaaagtgtctttaatgaatgtggctgcccttgcatttggagcgtagatattcagaattgagagttcctcttggaggattttacctttgatgagtatgaagtgtccctccttgtcttttttgataactttgggttggaagtcgattttatccgatattagaatggctactccagcttgtttcttcagaccatttgcttggaaaattgttttccagcctttcactctgaggtagtgtctgtctttttccctgagatgggtttcctgtaagcagcagaattttgggtcctgtttgtgtagccagtctgttagtctatgtctttttattggggaattgagtccattgatattaagagatattaaggaaaagtaattgttgcttctttttatttttgttgttagggttggcattctgttcttgtggctgtcttctttttggtttgttgagggattactttcttgcttgttttagggcgttaattccgtccttgtattgcttcttttctgttattatcctttgaagggctggattcttagaaagatattgtgtgaatttggttttgtcgtggaatactttggtttctccatctatggtaattgagagttttgccgggtatattagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtaggcttcttgtatgatcatgggcatctctttctttatgtttgggaagttttcttcaattattttgttgaagatattagctggccctttaagttgaaaatcttcattctcatcaattcctattatccgtaggtttggtcttctcattgtgtcctggattacctggatgttttgagttaggatccttctgcattttgtattttctttgactgttgtgtcgatgttctctatggagtcttctgcacctgagattctctcttccatttcttgtattctgttgctgatgctcgcatctatggttccagatctctttcctagggtttctatctccagcgttgcctcgctttgggttttctttattgtgtctacttccctttttagttctagtatggttttgttcatttccatcacctgtttggatgtgttttcctgtttttctttaaggacttctacctgtttggttgtgttttcctgcttttcttgaagtgcctgtaactctttagcagtgctctcctgtaattctttaagtgacttatgaaagtccttcttgatgtcctctatcatcatcatgagaaatgtttttaaatcttggtctagattttcggttgttttggggtgcccaggactaggtggggtgggaatgctgcgttctgatgatggtgaatggtcttgatttctgttagtaggattcttacatttgcctttcgccatctggtaatctctgaagctagctgttatagttgtcactgttaagagcttgttcttcaggtgactctgttagcctctataagcagacctgggagggtagctctctccttagtttcagtgggcagagtattctctgcaggcaagctctcttcttgcagggaaggtacccagatatttggtgttcgaaccggcctcctggcaggcactgtgttccactcaccagaggtcttaggatcccgtggggaatcctgtgtgggcccttgcagttgtcgggcgagtccgctggcaaggtaccccggggctcgagtggagcagaaggggcttgtgccccaggtcaggcccgggtagtctgcttccctatttcccacagtctcaggttctgcgtgattggattggggcaggcgctgtgttccactcaccagaggtcttaggatcccgtggggaatcctgtgtgggcccttgcgggtgtagggcgagtccgctggcaaggtaccctggggctcgagtggagcagaaggggcttgtgccccaggtcaggcctgggtagtctgcttccctatttcccacagtctcaggttctgcgcaattggattggggcaggcgctgggttccactcaccagaggtcttaggatcccatggggaatcctgtgtgggcccttgcgggtgtcgggcgagtctgctggcaaggtcgttagtaagattcttatgtgtgcctttcgccatctgataatctctggagtcagtttttttttagttgtctctggttagagcttgttcctttcgtgattatcttagcctctaccagcagacctgggagactagatctctcctgagtttcagtggttagagtactctctgcaggcaagttctcctcttgcagagaaggtgcacatgttggacttgcctcctggcagaagatgaagtcccgaagcagggcctgtcccagaagctgttagcttctgtcgtccacactctcactgtgcagactagtcttggcaggattcaggaatgaagatggctcctgcagatgctccatcaaagccctcctggacggggtggacacttcttttctggcagggaaggtgcctggatatctgcagcctgaaacagggtctgccacagaagttctgtggctcctgcctgtcccagatgctgttagcttttgtagtccacactctcacctgtgcagactagtcttggcagcatccgggaacaaagatggctcccgcagatgctctccaggattctcttttattttatagaaaatattaacttctgagggagaacatgccatatatttctggatttagcttaccttactcagggtgattttttttctaggtccatccatttacctacaaaatttatgttgccatttttttaacactgtttttagtaaatgtactgtattttcttcgggggggaggtattgagccagggtttctctgtagctctgtctgtcctggaactcactctatagatcaggccagcctcaaactcagaaatctgcctgatgctgccttccctatgcttggaataaaggtgtgcgccacgatgcctggcactgttttttttgtttgtttgttttttgttttttttacccatttttctgtttagtgacatctacatagttttcagtttttcgttattaggaatatgtgtgctatgtacatagttcaacaagtgtccttgtgataggatggaacatactttgtgtttattgcccaggtgtggtataagtaggtcatgaagtagattaatttccaattttctgagaaaactccatattgacttctaaagtgactgtataaggttacattaccattatcactgtaaaatcttgcttgttggttcccatccttgccagcatgagcaggcacttgacattcttatactagaaattctgacaggtgtaacatagaattacaaaataatttagaatttaaatctccggatagttttgaatgttacctaagaagaatttcttgaaatgaagttcatctgttaataattctgggtttagatctgtacctccttttttactggaatgtttgttttatagatttcttcttgaatttttatgtattttggatattagacatctgtcagatgtgaagttggtgaagatatcttcaaattctataggccaaaataagtaatgttgaagatgtcttttgttatacagaaggccatcagttgcatgatatctcatgtataaaagattactcttagagcctatgatactagtgttttatcatgaaaatatattctatacttagtaattaaaggttacccattctatgttcccttttagtaggttcagtgtatgtagagaagatgctacataagtgctggggaccaggaaccgcccatgtgtgctatttgtttgatgactcagtttttggaaaatattccgggtctaggttgctgctacagttggtattccatcccctacagcattttcaagtccttaccttaactgttctatagaagtcacttaattcagtccaatgatggactgtaagtatacattctatctcaggtaattgctggtagggacttacagagaataaatgtacacaagttgaaacaagcaaaaatagaagaagttgatcaaggagagagagaaggagagagagagagagagagagagagagagagagagagagagagagagagagagagagagagaggtgcttttcagctgaccctaattaagcctgctacctatgaggtagaattatgaaccctcagaggagattgattttgcatcatgcaaagatccagaagtattgatcagagaaggactggagccatgattgaaggctcaaaagttgtttgcttagatatccatggaggcccaatttggctggtggacttattcagagctgcctcctccttcttcgtcaaaaaggcaaggggaccaatgattgcccttgttattggctttttctgactggataattggagaagagccttcattcccttgaaaactttgctcaagacactggtggaggaagttgatggcttggacctaagagaaagtgttgagtacctgtattgcagctcacatatcatccttaagtccttagagggagctgaggacccagcaagcacttgagagcagagggcgtggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaattggggcatgttctctgtgctgtcatcacagggttgcattccctttccagtatggtacatggaaaacatgcagaggaaatggccccacagcattggctgagtgtttatgtcgtccaaccgagtctccatcgaacagttgtggtatggtgacttggcctaggtcacctgagttaaaaggtaaggaacatgggaattgctgcatgaattctaggtgcccaggtcttggtggagcagggaacggctgccattgatatgtccaggccttttgggacatggagcatgcctagggcctctgctttctcccaggtttggagcttcggcccattgttccctggcagtggattggcagtgtccagaagtccattgctctccccaaagccagagcactccagagtactggaacaactttatgcaatgcactccaacgtgcttggatctatgatgattcccagtcaaacattccttggaaaagctgaacaaaatgagtgaaaactctgtaccgccaatcacataggaactgaggtccagcatcttgggtctcccaggtgctatgggcgtcaggcacaggctgcccaaccactccattgttcctgacttcttcgggctctagccagactctccagagacaggtgagtgcttggcctactctgccaaaaatccatggcgtaggacacagcaggtccttaagctctggtggcttgctccctttgctgtagtggagatgcttggcagatactcagtaggtagtcgtgctaggtccaaggagagggccccagccattgtggaatgtagactgtgaggcaaaagtagcagtggcagtggcaccaaatcttggcctttcacatgggaatatctggcagtggactcaggcttctcagaagcacttatatgaattttaaccctgttgcattgctttacgtagtcaatagaatgcaggctgctggtagagtatagcttgaccctgtagcatgtaaacgggactgtgtaaatgttgtctgttcaggtggtgaacagaagcctctgtgtccctggcagcttggaagattcccgggcgattggcttggaaatagagaaggagctaagccttggaggtgatggcaggcacctcacgggtcagtttgcaccacatttaaacacttacctgggtctgtagacagaagaaactttgatggactcgctgggagcatgagactcgcagacctgtgtctcgatagatttggtgaaataacttttgttggaatctcttctttggtagttgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggactaactcttctggaaagacaagttgctagtgtgcataggaaggaggtttcaacagggcacatcgtgttttgcaaatccaccttgagagccaatctcacgggaatcatcagggagaacataatttcttggatgcagactgcatttgacacactaagataacttgagtcaagtcggatcctggcctgtggtagttctgcacaatgggattttcattagtgtgagaagctgagcagtatagtctgagaagttttcaccagaagagctcaaagcaggggtagatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacatacacacacacacacacacacactaacacagagagaaggagagggggggattcttttcagctgtgaaaatgaagcctgcttcccatgagctggaattctgaaccctcagaggagtttgattttacctcatggaaagacccagaagtaatgatcagaggactggagcaatgattgaaggctcaaaagttgtttgcttagatatccatggaggcccaattttgctggtggaattattcagagctgcctccttcttcttcgtcagcataagcaagtggacctatgattgcccttgtttttggctttttctgactggatgcttggagatgagccttcatttccctgaaaactttgctcaggacactggtggaggaagttgatggcttggacctaagagaaaatgatgagtatctgtatttcacctcacatatcatcgtaaagtccttagagggagctgagtatcaagcaagcacttgagagcaaagggcatgacatgttcacatccaaggccggagagtaacagcaagtgagatctggaagggcagtgtgaagaagttggtaagagcaggagttttgagggtgtctgtgagatatgacaagcccaaagtacatggtaagcccataatccatgtggatttgaattggtcccaatgtaatcagggcatgttctctgtgctctcttctagggctgcattccctttctagtatggtccatgaaaaacatgcagaggaaatggccccaaagcattggctgagagtttatgtcgtccaactgagtctccattgaactgttgtggtgttgctgacttgccctaggtcacctgagttaaaaggtaaggaacatgggaattgctgcatgaattctaggtgcccaggtcttggtggagcagggaacggctgccattgattatgtccaggcccttcgggacatggagcatgcctagggccctggtttctcccatgtttggagctttggcccattgttccctggcagtagattggcagtccagcagtccattgctctccccaaagccaaagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctattctgacaaaaatccatggtctaggacacagcaggtccttaagctctggtggcttgctccctttgctgtagtggagatgcttggcagatactcagtaggtagtcgtgctaggtccaaggagaggaccccagccattgtggaatgtagactgtgaggcaaaagtagcagtggcagtggcaccaaatcttggcctttcacatgggaatatctggcagtggactcaggcttctcagaagcacttatatgaatttaaaccctgttgcattgctttacgtagtcaatagaatgcaggctgctggtagagtgtaacttgacccagtagcatgtaaacgggactgtgtgaatgttgtctgttcaggtgatgaacagaagcctctgtgtccctggcagcttggatgtttcccgggcgattggcttggaatagagaaggagctaagccttggaggtgatggcaggcacctcacgggtcagtttgcaccacatttacacacttacctgtgtctgtagatggatgaaactttgatgaactcgctgggagcatgagacttgcagacctgtgtctcgatagatttgttgaaataactttggtaggaaactcctctttggtaggtgctgttgctttggatgttgttgaagggatatccttggtatatttggacatagttgtcagcctccttgtctaggtcaaagggaaagtctaggaacagttcttgcacccacagccttaggagaaccatcttggtgagggaccctctaatttagagaccaaagtgtcatgggacctttcttttcaattttttggcctaacagttctggaaaggcaagttgatagtgtgcataggaaggaggtttcagcagggcacatcgtgttttgcaaatccaccttgagagccatgctcatggggatcatcagggagaaaataagttcttggatgcagactgcatttgacacactaagataacttgagtcaagttggatcctggcctgtgataattctgcacgatgggattttcaatagtgtgagaagctgagcagtatagtctgagaacttttcaccagaagagatcaaagtaggggtggatggccaaaagcaatctcatgagagaggtggaagtcttcacaacagacaaaatgagcactggacaggtggacagaaatagggactggctgccacagcaaggaatgtctcagggtaaaagacacacacacacaaacacacacatacacacacacacacacacactaacacagagagaaggagagagaggggggattcttttcagctgtgcaaatgaagcctgcttcccatgagctggaattctgaaccctcagaggagtttgattttacctcatgcaaagacccagatgtaatgatcagagaaggactggagccatgattgaaggctcaaaatttgtttgcttagatatccatggaggcccaattttgctggtggacttattcagagctgcctcccccttcttcttcagcataggcaaggggccctatgattgcccttgttattggctttttctgactggatgcttggataagagccttcattcccttgaaaactttgctgaggacactggtggaggaagttgatggcatggacgtaagagaaagtgttgagtacctgtattgcagatcacatatcatccttaagtccttagagggagctgaggacccagcaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatgatccatagaaaacatgcagaggaaatggccccacagcattggctgagtgtttatgtcgtccaactgagtctccatcgaactgttgtggtgttgctgacttgccctaggtcacctgagttaaaaggtaaggaacatgggaattgctgcatgaattctaggtgcccaggtcttggtggagctgggaacggctgccattgatatgtccaggcccttcaggacatggagcatgcctagggcgtctggtttctcccaggtttggagcttcggcccattgttccctggcagtggattggcagtgtccagcagtccattgctctccccaaagccaaagcactccagagtactggaaccactttatgcaatgcactcccacctgctcggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctattctgacaaaaatccatggtctaggacacagcaggtccttaagctctggtggcttgctccctttgctgtagtggagatgcttggcagatactcagtaggtagtcctgctaggtccaaggagaggaccccagccattgtggaatgtagactgtgaggcaaaagtagcagtggcagtggcaccaaatcttggcctttcacatgggaatatctggcagtggactcaggcttctcagaagcacttatatgaatttaaaccctgttgcattgctttacgtagtcaatagaatgcaggctgctggtagagtgtaacttgacccagtagcatgtaaacgggactgtgtgaatgttgtctgttcaggtgatgaacagaagcctctgtgtccctggcagcttggatgtttcccgggcgattgtcttggaatagagaaggagctaagccttggaggtgatggcaggcacctcacgggtcagtttgcaccacatttacacacttacctgtgtctgtagatggatgaaactttgatgaactcgctgggagcatgagacttgcagacctgtgtctcgatagatttgttgaaataactttggtaggaaactcctctttggtaggtgctgttgctttggatgttgttgaagggatatccttggtatatttggacatagttgtcagcctccttgtctaggtcaaagggaaagtctaggaacagttcttgcacccacagccttaggagaaccatcttggtgagggaccctctaatttagagaccaaagtgtcatgggacctttcttttcaattttttggcctaacagttctggaaaggcaagttgatagtgtgcataggaaggaggtttcagcagggcacatcgtgttttgcaaatccaccttgagagccatgctcatggggatcatcagggagaaaataagttcttggatgcagactgcatttgacacactaagataacttgagtcaagttggatcctggcctgtgataattctgcacgatgggattttcaatagtgtgagaagctgagcagtatagtctgagaacttttcaccagaagagatcaaagtaggggtggatggccaaaagcaatctcatgagagaggtggaagtcttcacaacagacaaaatgagcactggacaggtggacagaaatagggactggctgccacagcaaggaatgtctcagggtaaaagacacacacacacaaacacacacatacacacacacacacacacactaacacagagagaaggagagagaggggggattcttttcagctgtgcaaatgaagcctgcttcccatgagctggaattctgaaccctcagaggagtttgattttacctcatgcaaagacccagatgtaatgatcagagaaggactggagccatgattgaaggctcaaaatttgtttgcttagatatccatggaggcccaattttgctggtggacttattcagagctgcctcccccttcttcttcagcataggcaaggggccctatgattgcccttgttattggctttttctgactggatgcttggataagagccttcattcccttgaaaactttgctgaggacactggtggaggaagttgatggcatggacataagagaaagtgttgagtacctgtattgcagatcacatatcatccttaagtccttagagggagctgaggacccagcaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatgatccatagaaaacatgcagaggaaatggccccacagcattggctgagtgtttatgtcgtccaactgagtctccatcgaactgttgtggtgttgctgacttgccctaggtcacctgagttaaaaggtaaggaacatgggaattgctgcatgaattctaggtgcccaggtcttggtggagctgggaacggctgccattgatatgtccaggcccttcaggacatggagcatgcctagggcgtctggtttctcccaggtttggagcttcggcccattgttccctggcagtggattggcagtgtccagcagtccattgctctccccaaagccaaagcactccagagtactggaaccactttatgcaatgcactcccacctgctcagatctatgatgatttccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccaaagacaggtgtgtgcttggcctattctgccaaaaatccatggtctaggacacagcaggtccttaagctctggtggcttgctccctttgctgtagtggagatgcttggcagatactcagtaggtagtcgtgctaggtccaaggagaggaatccagccattgtggaatgtagactgtgaggcaaaagtagcagtggcagtggcaccaaatcttggcttttcacatgggaatatctggcagtggactcaggcttctcagaagcacttatatgaatttaaaccctgttgcattgctttacgtagtcaatagaatgcaggctgctggtagagtgtaacttgacccagtagcatgtaaacgggactgtgtgaatgttgtctgttcaggtgatgaacagaagcctctgtgtccctggcagcttggaagtttcccgggtgattggctaggaaatagagaaggagctaagccttggaggtgatggcaggcacctcacgggtcagtttgcaccacatttacacacttacctgtgtctgtagatggatgaaactttgatgaactcgctgggagcatgagacttgcagacctgtgtctcgatagatttgttgaaataactttggtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcaggggacctttcttttcgatgttttggcctaacacttatggaaagacaagttgctagtgtgcataggaaggaggtttcaacagtgcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaactttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacgcacacagacacacacacacacacacactaacaaagagagagggagagagagggggttcctttcagctgtgaaaatgaagcctgcttccaatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttttttgactgcataggcaaggggacctctgattgcccttgttattggttttttctgactggatgcttcgagaagagccttcattcccttgaaaactttgcttaggacactggtggaggaagttgatgacatggacctaagagaaagtgttgagtacctgtattgcagctcacatatcatccttaagtccttagagtgagctgaggaccaagcaagcacttgagagcaaagggcatggcatgttcacattcaaggcctgagagtaacagcaagtgagatctggaaaggcagtgtgaagaggttggtaagagcaggagtgttgagggtgcctgtgagatatgacaagcccatagtacatggtaagcccataatccatgtggttttgcattggtcccactgtaatcggggcatgttctttgtgttgtcttcacagggttgcattccctttccagtatggtccatggaaaacatgcagaggaaatggccccacagcattggctgagtgtttatgtcgaccaacttagtctccatcgacctgttgtggtgttgctgacttgccctaggtcacctgagttaaatggtaaggaacatgggaattgctgcatgaattctaggtgcccaggtcttggtggagcaggtaacggctgccattgaatatgtccaggcccttcgggacatggagcatgcctagggcctctggtttctcccatgtttggagcttcggcccattgttccctggcagtggattgtcagtgtccagaagtccattgctctccccaaagccagagcactccagagtacaggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggactcaggcttctcagaagcacttatatgaattttaaccctgttgcattgctttacgtagtcaatagaatgcaggctgctggtagagtgtagcttgacccagtagcatgtaaatgggactgtgtgactgttgtcatttcaggtggtgaacagaaggctctgtgtccctggcagcttggatgtttccccggggggttgctaggaaatagagaaggagctaagccttggaggtgatggcaggcacctcacgggtcagtttgtaccacatttacacatttacctgtgtctgtagacggatgaaactttgatggactcgctggcagcatgagacttgcagacctgtgtctccatagatttgttgaaataatttttgtaggaatctcctctttggtaggtgctgttgctttggatgttgttgaagggatatccttggtatatttggacattgttgtcagcctccttggcaaggtcaaagggaaagtctaggaacggttcttgcacccacagccttaggagaaccatcttggcgagggaccctctaaattagagaccaaggtgtcatgggacctttcttttcgatgttttggcctaactcttctggaaagacacgttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacactaacacagagagagggagagagaggggggttcctttcagctgtgaaaatgaagcctgcttcccatgacctggagtctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctcctttttcgactgcataggcaaggggacttatgattgcacttgttattggttttttctgactggatgcttggagagagccttcattcccttgaaaactttgctcaggacactggtggatgaagttgatggcatggatctaagagaaagtgttgagtacttgtattgcagctcacatatcatccttaagtccttagagtgagctgaggacccagcaagcacttgaaagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggtattgcattggtcccactgtaatcagggcatgttctttgtgttgtcttcacagggttgcattccctttccagtatggtccatggaaaacatgcagaggaaatggccccacagcattggctgagagtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcaggcctagggcctctggtgtctcccatgtttggagcttcggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggtgtaggacacagcacgtccttaagctctggtggcttggtccctttgctgtagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtaacatttaaacgggactgtgtgactgttgtcggttcaggtggtgaacagaaggctctgtgtccctggcagcttggaagtttcccgggggattggctaggaaatagaggaggagctaacctttggaggtgatggcaggcacctcacgggtcagtttgcaccacatttacacacttacctgtgtctgtagacggatgaaactttgatggactcgctggcagcatgagacttgcagacctgtgtctcgatagatttgttgaaataactttggtaggaatctcctctttggtaggtgctgttgctttggatgttgtggaagggatatccttggtatatttggaccttgttgtcagcctgcttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacattaacacagagagagggagagagaggggggttcctttcagctgtgaaaatgaagcctgcttcccatgagctgtaattctgaactctcagaggagtttgattttacctcatgcaaagtcccagaagcaatgatcagagaaggactggagccatgattgaaggctcaaaagttgttggcttagatatccttggaggcccaattttgctggtggagttattcagagctgcctcctccttcttcgactgcataggcaaggggacctatgattgcccttgttattggctttttctgactgcatgcttggagaagagccttcattcccggtaaaactatgctcaggacactggtggaggaagttgatggcaaagacctaagagaaagtgttgagtaccagtattgcagctcacatatcatccttaagtccttagagtgagctgaggacccagcaagcacttgagacaaagggattggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcagggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggcacatgggaattgctgcatgaattctaggtgcccaggtcttggtggagcagggaacagctgccattgattatgtccaggcccttcgggacatggagcatgcctagggcctctggtttctcccatgttttgagctttggcccattgttccctggcagtggattgtcagtgtccagcagtccattgctctccccaaagccagagcactccagagtactggaaccacttaatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaacactccattgttcttgacttcttcgggctctagccagactctccagagacaggtgtgtgcttggcctactctgccaaaaattcatggtgtaggacacagcaggtccttaagcactggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggactcaggcttctcagaagcacttatatgaattttaaccctgttgcattgctttacgtaatcaatagaatgcaggctgctggtagagtgtagcttgacccattagcatgtaaatgggactgtgtgactgttgtcagttcaggtggtgaacagaaggctctgtgtccctggcagcttggaagtttcccgggggataggctaggaaatagaggaggagctaacctttggaggtgatggcaggcacctcacgggtcagtttgcaccacatttacaaacttacctgtgtctgtagacggatgaaactttgatggactcgctggcagcatgagacttgcagacctgtgtcttgatagatttgttgaaataatttttgtaggaatctcctctttggtaggtgctgttgctttggatgttgttgaagggatatccttggtatatttggaccttgttgtcatcctccttggcaaggtcaaagggaaagtctaggaacagttcttgcacttacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaactttcaccagaagagaccaaagcaggggtggatggccaaaagcaatctcatgagagaggtggaagtcttcacaacagacaaaatgagcactggataggtagacagaaatagagactggctgccacagcaaggaatgtctcagggtaaaagacacacacacacacacacacacacacacacagacacacacacacacacacacactaacacagagagagggagagagaggggggttcctttcagctgtgaaaatgaagcctgcttcccatgacctggagttctgaactctcagaggagcttgattttacctcatgcaaagacacagaagtaatgatcagagaaggactggagccatgattgaaggctcaaaagttgttggcttagatatccttggaggcccaattttgctggtggagttattcagagctgcctcctccttctttgtcagcataggcaaggggacctatgattgcccttgttattggctttttctgactggatgcttggagaagagccttcattcccttgaaaactttgcacaggacactggtggaagaagttgatggcatggacctaagagaaagtgttgagtacctgtattgcagctcacatatcatccttaagtccttagagtgagctgaggacccagcaagcacttgagagcaaagggcatggcatgttcccatccaaggcctgagagtaacagcaagtgagatctggaggggcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatgatccatagaaaacatgcagaggaaatggccccacagcattggctgagagtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccagttgctatgggcatcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtggatagtcgtgctaggtccatggagagggccccagccattgtggaaagtagactgtgaggcaaaagtagcagtggcagtggcaccaaatcatggcttttcacatgggaatatcaagcagtggactccggcttcagaagcacttatatgaattttaaccctgttgcattgctttacgtaatcaatagaatgcaggctgctggtagagtgtagcttgacccattagcatataaacgggactgtgtgactgttgtcggttcaggtggtgaacagaaggctctgtgtcccaggcagcttggaagtttcccggggggttggctaggaaatagagaaggagctaagccttggaggtgatggcaggcacctcacgggtcagtttgcaccacatttacacacttacctgtgtttgtagacggatgaaactttgatggactcgctgggagcatgagacttgcagacctgtgtctcgatagatttgttgaaataatttttgaaggaatctcctctttggtaggtgctgttgctttggatgttgtggaagggatatccttggtatatttggaccttgttgtcagcctgcttggcaaggtcaaagggaaagtctaggaacagttcttgcacccacagccttaggagaaccatcttgttgagggaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacacacacagacacacacacacacacacactaacaaagagagagggagagagagggggttcctttcagctgtgaaaatgaagcctgcttccaatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttttttgactgcataggcaaggggacctctgattgcccttgttattggttttttctgactggatgcttcgagaagagccttcattcccttgaaaactttgcttaggacactggtggaggaagttgatgacatggacctaagagaaagtgttgagtacctgtattgcagctcacatatcatccttaagtccttagagtgagctgaggaccaagcaagcacttgagagcaaagggcatggcatgttcacattcaaggcctgagagtaacagcaagtgagatctggaaaggcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatggtccatggaaaacattcagaggaaatggccccacagcattggctgagtgtttatgtcgaccaacttagtctcgatcgacctgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagaagtccattgctctccccaaagccagagcactccagagtacaggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggactcaggcttctcagaagcacttatatgaattttaaccctgttgcattgctttacgtagtcaatagaatgcaggctgctggtagagtgtagcttgacccagtagcatgtaaatgggactgtgtgactgttgtcatttcaggtggtgaacagaaggctctgtgtccctggcagcttggatgtttcccaggggggttgctaggaaatagagaaggagctaagccttggaggtgatggcaggcacctcacgggtcagtttgtaccacatttacacatttacctgtgtctgtagacggatgaaactttgatggactcgctggcagcatgagacttgcagacctgtgtctccatagatttgttgaaataatttttgtaggaatctcctctttggtaggtgctgttgctttggatgttgttgaagggatatccttggtatatttggacattgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacacgttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaactttttaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacactaacacagagagagggagagagaggggggttcctttcagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctcctttttcgactgcataggcaaggggacttatgattgcacttgttattggttttttctgactggatgcttggagagagccttcattcccttgaaaactttgctcaggacactggtggatgaagttgatggcatggatctaagagaaagtgttgagtacttgtattgcagctcacatatcatccttaagtccttagagtgagctgaggacccagcaagcacttgaaagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaatcccataatccatgtggtattgcattggtcccactgtaatcagggcatgttctttgtgttgtcttcacagggttgcattccctttccagtatggtccatggaaaacatgcagaggaaatggccccacagcattggctgagagtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcaggcctagggcctctggtgtctcccatgtttggagcttcggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggtgtaggacacagcacgtccttaagctctggtggcttggtccctttgctgtagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtaacatttaaacgggactgtgtgactcttgtcggttcaggtggtgaacagaaggctctgtgtccctggcagcttggaagtttcccgggcgattggctaggaaatagaggaggagctaacctttggaggtgatggcaggcacctcacgggtcagtttgcaccacatttacacacttacctgtgtctgtagacggatgaaactttgatggactcgctggcagcatgagacttgcagacctgtgtctcgatagatttgttgaaataactttggtaggaatctcctctttggtaggtgctgttgctttggatgttgtggaagggatatccttggtatatttggaccttgttgtcagcctgcttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacattaacacagagagagggagagagaggggggttcctttcagctgtgaaaatgaagcctgcttcccatgagctggaattctgaactctcagaggagtttgattttacctcatgcaaagtcccagaagcaatgatcagagaaggactggagccatgattgaaggctcaaaagttgttggcttagatatccttggaggcccaattttgctggtggagttattcaaagctgcctcctccttcttcgactgcataggcaaggggacctatgattgcccttgttattggctttttctgactgcatgcttggagaagagccttcattcccgtgaaaactatgctcaggacactggtggaggaagttgatggcaaagacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcagggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggcacatgggaattgctgcatgaattctaggtgcccaggtcttggtggagcagggaacagctgccattgattatgtccaggcccttcgggacatggagcatgcctagggcctctggtttctcccatgttttgagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaacactccattgttcttgacttcttcgggctctagccagactctccagagacaggtgtgtgcttggcctactctgccaaaaattcatggtgtaggacacagcaggtccttaagcactggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggactcaggcttctcagaagcacttatatgaattttaaccctgttgcattgctttacgtaatcaatagaatgcaggctgctggtagagtgtagcttgacccattagcatgtaaatgggactgtgtgactgttgtcagttcaggtggtgaacagaaggctctgtgtccctggcagcttggaagtttcccgggggataggctaggaaatagaggaggagctaacctttggaggtgatggcaggcacctcacgggtcagtttgcaccacatttacaaacttacctgtgtctgtagacggatgaaactttgatggactcgctggcagcatgagacttgcagacctgtgtcttgatagatttgttgaaataatttttgtaggaatctcctctttggtaggtgctgttgctttggatgttgttgaagggatatccttggtatatttggaccttgttgtcatcctccttggcaaggtcaaagggaaagtctaggaacagttcttgcacttacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaactttcaccagaagagatcaaagcaggggtggatggccaaaagcaatctcatgagagaggtggaagtcttcacaacagacaaaatgagcactggataggtagacagaaatagagactggctgccacagcaaggaatgtctcagggtaaaagacacacacacacacacacacacacacacacacacacacacacacactaacacagagagagggagagagaggggggttcctttcagctgtgaaaatgaagcctgcttcccatgacctggagtctgaactctcagaggagcttgattttacctcatgcaaagacacagaagtaatgatcagagaaggactggagccatgattgaaggctcaaaagttgttggcttagatatccttggaggcccaattttgctggtggagttattcagagctgcctcctccttctttgtcaggataagcaaggggacctatgattgcccttgttattggctttttctgactggatgcttggagaagagccttcattcccttgaaaactttgctcaggacactggtggaagaagttgaatacatggacctaagagaaagtgttgagtacctgtattgcagctcacatatcatccttaagtccttagagtgagctgaggacccagcaagcacttgagacaaagggcatggcatgttcccatccaaggcctgagagtaacagcaagtgagatctggaggggcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatgatccatagaaaacatgcagaggaaatggccccacagcattggctgagagtttatgtcgtccaactgagtctccatcgaactgttgtggtgttgctgacttgccctaggttacctgagttaaatggtaaggaacatgggaattgctgcatgaattctaggtgcccaggtcttggtggagcagggaacggctgccattgattatgtccaggcccttcaggacatggagcatgcctagggcctctggtttctcccatgtttggagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccagttgctatgggcatcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtggatagtcgtgctaggtccatggagagggccccagccattgtggaaagtagactgtgaggcaaaagtagcagtggcagtggcaccaaatcatggcttttcacatgggaatatcaagcagtggactccggcttcagaagcacttatatgaattttaaccctgttgcattgctttacgtaatcaatagaatgcaggctgctggtagagtgtagcttgacccattagcatataaacgggactgtgtgactgttgtcggttcaggtggtgaacagaaggctctgtgtcccaggcagcttggaagtttcccggggggttggctaggaaatagagaaggagctaagccttggaggtgatggcaggcacctcacgggtcagtttgcaccacatttacacaccacctgtgtttgtagacggatgaaactttgatggactcgctgggagcatgagacttgcagacctgtgtctcgatagatttgttgaaataatttttgaaggaatctcctctttggtaggtgctgttgctttggatgttgtggaagggatatccttggtatatttggaccttgttgtcagcctgcttggcaaggtcaaagggaaagtctaggaacattttttgcacccacagccttaggagaaccatcttgttgagggaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacagacacacacacacacacacacactaacaaagagagagggagagagagggggttcctttcagctgtgaaaatgaagcctgcttccaatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttttttgactgcataggcaaggggacctctgattgcccttgttattggttttttctgactggatgcttcgagaagagccttcattcccttgaaaactttgcttaggacactggtggaggaagttgatgacatggacctaagagaaagtgttgagtacctgtattgcagctcacatatcatccttaagtccttaaagtgagctgaggaccaagcaagcacttgagagcaaagggcatggcatgttcacattcaaggcctgagagtaacagcaagtgagatctggaaaggcagtgtgaagagtttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatggtccatggaaaacattcagaggaaatggccccacagcattggctgagtgtttatgtcgaccaacttagtctcgatcgacctgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagaagtccattgctctccccaaagccagagcactccagagtacaggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatggacgtcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggactcaggcttctcagaagcacttatatgaattttaaccctgttgcattgctttacgtagtcaatagaatgcaggctgctggtagagtgtagcttgacccagtagcatgtaaatgggactgtgtgactgttgtcatttcaggtggtgaacagaaggctctgtgtccctggcagcttggatgtttccccggggggttgctaggaaatagagaaggagctaagccttggaggtgatggcaggcacctcacgggtcagtttgtaccacatttacacatttacctgtgtctgtagacggatgaaactttgatggactcgctggcagcatgagacttgcagacctgtgtctccatagatttgttgaaataatttttgtaggaatctcctctttggtaggtgctgttgatgtggatgttgttgaagggatatccttggtatatttggacattgttgtcagcctccttggcaaggtcaaagggaaagtctaggaacagttcttgcacccacagccttaggagaaccatcttggcgagggaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaaattttaccagaagatatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacactaacacagagagagggagagagaggggggttcctttcagctgtgaaaatgaagcctgcttcccatgagctggaattctgaactctcagaggagtttgattttacctcatgcaaaacccagaagtaatgatcagagaaggactggagccatgattgaaggctcaaaagttgttggcttagatatccttggaggcccaattttgctggtggagttattcagagctgcctcctcctttttcgactgcataggcaaggggacttatgattgcacttgttattggttttttctgactggatgcttggagagagccttcattcccttgaaaactttgctcaggacactggtggatgaagttgatggcatggatctaagagaaagtgttgagtacttgtattgcagctcacatatcatccttaagtccttagagtgagctgaggacccagcaagcacttgaaagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggtattgcattggtcccactgtaatcagggcatgttctttgtgttgtcttcacagggttgcattccctttccagtatggtccatggaaaacatgcagaggaaatggccccacagcattggctgagagtttatgtcgtccaactgagtctccattgaactgttgtggagttgctgacttgccctagggcacctgagttaaatggtaaggaacatgggaattgctgcatgaattctaggtgcccaggtcttggtggagcagggaacggctgccattgattatgtccaggcccttcgggacatggagcaggcctagggcctctggtgtctcccatgtttggagcttcggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcgtaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggtgtaggacacagcacgtccttaagctctggtggcttgctccctttgccgtagtggagatgcttggcagatactcagtaggtagtcatgctaggtccaaggagagggccccagccattgtggaaagtagactgtgaggcaaaagtagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtaacatttaaacgggactgtgtgactgttgtcggttcaggtggtgaacagaaggctctgtgtccctggcagcttggaagtttcccgggcgattggctaggaaatagaggaggagctaacctttggaggtgatggcaggcacctcacgggtcagtttgcaccacatttacacacttacctgtgtctgtagacggatgaaactttgacggactcgctggcagcatgagacttgcagacctgtgtctcgatagatttgttgaaataactttggtaggaatctcctctttggtaggtgctgttgctttggatgttgtggaagggatatccttggtatatttggaccttgttgtcagcctgcttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacattaacacagagagagggagagagaggggggttcctttcagctgtgaaaatgaagcctgcttcccatgagctggaattctgaactctcagaggagtttgattttacctcatgcaaagtcccagaagcaatgatcagagaaggactggagccatgattgaaggctcaaaagttgttggcttagatatccttggaggcccaattttgctggtggagttattcagagctgcctcctccttcttcgactgcataggcaaggggacctatgattgcccttgttattggctttttctgactgcatgcttggagaagagccttcattcccgtgaaaactatgctcaggacactggtggaggaagttgatggcaaagacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagtggttggtaagagcaggagtgttgagggtgcctgtgagatatgacaagcccatagtacatggtaagcccataatccatgtggttttgcattggtcccactgtaatcagggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggcacatgggaattgctgcatgaattctaggtgcccaggtcttggtggagcagggaacagctgccattgattatgtccaggcccttcgggacatggagcatgcctagggcctctggtttctcccatgttttgagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaattcatggtgtaggacacagcaggtccttaagcactggtggcttgctccctttgctgtagtggagatgcttggcagatactcagtaggtagtcgtgctaggtccaaggagagggccccagccattgtggaaagtagattgtgaggcaaaagtagcagtggcagtggcaccaaatcttggctattcacatgggaatatcaagcagtggagacaggcttctcagaagcacttatatgaattttaaccctgttgcattgcattacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagacgaatgaaactttgatggactcgttggcagcatgagacttgcagacctgtgtctcgatagatttgttaaaataactttggtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacacacacacattaacacagagagagggagagagaggggggttcctttcagctgtgaaaatgaagcctgcttcccatgagctggaattctgaactctcagaggagtttgattttacctcatgcaaagtcccagaagcaatgatcagagaaggactggagccatgattgaaggctcaaaagttgttggcttagatatccttggaggcccaattttgctggtggagttattcagagctgcctcctccttcttcgactgcataggcaaggggacctatgattgcccttgttattggctttttctgactgcatgcttggagaagagccttcattcccgtgaaaactatgctcaggacactggtggaggaagttgatggcaaagacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcagggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggcacatgggaattgctgcatgaattctaggtgcccaggtcttggtggagcagggatcagctgccattgattatgtccaggcccttcgggacatggagcatgcctagggcctctggtttctcccatgttttgagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaattcatggtgtaggacacagcaggtccttaagcactggtggcttgctccctttgctgtagtggagatgcttggcagatactcagtaggtagtcgtgctaggtccaaggagagggccccagccattgtggaaagtagattgtgaggcaaaagtagcagtggcagtggcaccaaatcttggctattcacatgggaatatcaagcagtggagacaggcttctcagaagcacttatatgaattttaaccctgttgcattgcattacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagacggatgaaactttgatggactcgttggcagcatgagacttgcagacctgtgtctcgatagatttgttaaaataactttggtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacacacacacacacacattaacacagagagagggagagagaggggggttcctttcagctgtgaaaatgaagcctgcttcccatgagctggaattctgaactctcagaggagtttgattttacctcatgcaaagtcccagaagcaatgatcagagaaggactggagccatgattgaaggctcaaaagttgttggcttagatatccttggaggcccaattttgctggtggagttattcagagctgcctcctccttcttcgactgcataggcaaggggacctatgattgcccttgttattggctttttctgactgcatgcttggagaagagccttcattcccgtgaaaactatgctcaggacactggtggaggaagttgatggcaaagacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcagggcatgttctttgtgttgtcttcacagggttgcattccctttccagaatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacagctgccattgattatgtccaggcccttcgggacatggagcatgcctagggcctctggtttctcccatgttttgagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtggaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaattcatggtgtaggacacagcaggtccttaagcactggtggcttgctccctttgctgtagtggagatgcttggcagatactcagtaggtagtcgtgctaggtccaaggagagggccccagccattgtggaaagtagattgtgaggcaaaagtagcagtggcagtggcaccaaatcttggctattcacatgggaatatcaagcagtggagacaggcttctcagaagcacttatatgaattttaaccctgttgcattgcattacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggcgattggctaggaaatagagaaggagcaaagccttggaggtgatggcaggcacctcacgggtcagtttgcaccacatttacacacttacctgtgtctgtagacggatgaaactttgatggactcgctggcagcatgagacttgcagacctgtgtctcgatagatttgttaaaataactttggtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacatcgtgttttgcaaatccattttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacactaacacagagagagggagagagagggggttcctttcagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaatattgctggtggagttattcagagctgcctcctccttcttcgactgcataggcaaggggacctataattgcccgtgttattggctttttctgactgcatgcttggagaagagcctccattcccttgaaaactatgctcaggacactggtggaggaagttgatggcaaagacctaagagaaagtgttgagtacctgtattgcagctcacatatcatccttaagtccttagagtgagctcaggacccagcaagcacttgagacaaagggcatggcatgttcacatccaaggcctgagagtaacagcaagtgagatctggaagagcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatgatccatagaaaacatgcagaggaaatggccccacagcattggctgagagtttatgtcgtccaaccgagtctccatcgaactgttgtggtgttgctgactggccctaggttacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccatttctctccccaaagccagagcaatccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttctggctctagccagactctccagagacaggtgtgtgcttggcctactctgccaaaaatccatggcgtaggacacagcaggtccttaagctctggtggcttgctccctttgctgtagtggagatgcttggcagatactcagtggatagtcatgctaggtccaaggagagggccccagccattgtggaaagtagactgtgaggcaaaagtagcagtggcagtggcaccataacatggcttttcacaggggaatatcaagcagtggactccggcttctcagaagcacttatatgaattttaaccctgttgcattgctttacataatcaatagaatgcaggctgctggtagagtgtagcttgacccattagcatgtaaatgggactgtgtgactgttgtcagttcagttggtgaacagaaagctctgtgtccctggcagcttggaagtttcccgggggataggctaggaaatagagaaggagctaagtcttggaagtgatggcaggcacctcacgggtcagtttgcaccacatttacacacttacctgtgtctgtagaccgatgaaactttgatggactcgctggcagcatgagacttgcagacctgtgtctccatagatttgttgaaataatttttgaaggaatctcctctttggtaggtgctgttgctttggatgttgtggaagggatatccttggtatatttggaccttgttgtcagcctgcttggcaaggtcaaagggaaagtctaggaacagttcttgcacttacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggataggtagacagaaatagagcctggctgccacagcaaggaatgtctcagggtaaaagacacacacacacacacacacacacacacacacacacactaacacagagagagggagagagaggggggttcctttcagctgtgaaaatgaagcctgcttcccatgacctggagttctgaactctcagaggagcttgattttacctcatgcaaagacccagaagtaatgatcagagaaggactggagccatgattgaaggctcaaaagttgttggcttagatatccttggaggcccaatattgctggtggagttattcagagctgcctccttcttcgtcagcataggcaaggggacctatgattgcccttgttattggctttttctgactggatgcttggagaagagccttcattcccttgaaactttgctcaggacactggtggaagaagttgatggcatggacctaagagaaagtgttgagtacctgtattgcagctcacatatcatccttaagtccttagagtgagctgaggacccagcaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcaggtaacggctgccattgaatatgtccaggcccttcgggacatggagcatgcctagggcctctggtttctcccatgtttggagcttcggcccattgttccctggcagtggattgtcagtgtccagcagtccattgctctccccaaagccagagcactccagagtcctggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagccaggtgtgtgcttggcctactctgccaaaattccatggtgtaggacacagcacgtccttaagctctggtggcttgctccctttgctgtagtggagatccttggcagatactcagtaggtagtcgtgctaggtccaagaagagggccccagccattgtggaaagtagactgtgaggcaaaagaagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtaacatttaaacgggactgtgtgactgttgtcggttcaggtggtgaacagaaggctctgtgtcccttgcagcttggaagttcccgggggattggctaggaaatagaggaggagctaacctttggaggtgatggcaggcacctcacgggtcagtttgcaccacatttacacacttacctgtgtctgtagacggatgaaactttgatggactcgctgggagcatgagacttgcagacctgtgtctcaatagatttgttgaaataactttggtaggaatgtcctctttggtaggtgctgttgctttggatgttgttgaagggatatccttggtatatttggaccttgttgtcagcctccttggcaaggtcaaagggaaagtctagaaacagtttttgcacccacagccttaggagaaccatcttggtgagggaccctctaaattagagaccaaggtgtcaggggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggataggtagacacgaaatagagactggctgccacagcaaggaatgtctcagggtaaaagacacacacacacacacacacacacacacacacacacacacacacacacacacacacaaacactaacacagagagagggagagagagggggtttcctttcagctgtgaaaatgaagcctgcttcccatgacctggagttctgaactctcagaggagcttgattttacctcatgcaaagacccagaagtaatgatcagagaaggactggagccatgattgaaggctcaaaagttgttggcttagatatgcttggaggcccaattttgctggtggagttattcagagctgcctcctccttcttcgactgcataggcaaggggacctatgattgcccttgttattggctttttctgactgcatgcttggagaagagccttcattcccgtgaaaactatgctcaggacactggtggaggaagttgatggcaaagacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctaggtgcccaggtattggtggagcagggaatggctgccattgattatgcccaggcccttcgtgacatggagcatgcctagggcctctggtttctcccatgtttggagcttcggcccattgttccctggcagtggattgtcagtgtccagcagtccattgctctccccaaagccagagcactccagagtactggaaccacttgatgcaatgcactccaaggtgcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaacactccattgttcttgacttcttcgggctctagccagactctctagaggcaggtgtgtgcttggactactctgccaaaaatccaaggcataggacagagaacgtccttaagctctggtggcttgctccctttgctgtagtggagatgcttggcagatactcagtaggtagtcatgctaggtccaaggaaagggccccagccattgtggaaagtagactgtgaggaaaagtagcagtggcagtggcaccaaaacttggcttttcacatgggaatatcaagcagtggactcaggcttctcagaagcacttatatgaattttaaccctgttgcattgatttacttaatcaatagaatgcaggctgctggtagagtgtagcttgacccagtagcatgtaaacgggactgtgtgactgttgtcggttcaggtggtgaacagaaggctctgtgtcccttgcagcttggaagtttcccgggggattggctaggaaatagaggaggagctagcctttggaggtgatggcaggcacctcacgggtcagtttgcaccacatttacacacttacatgtgtctgtagacggatgaaactttgatggactcgctggcagcatgagacttgcagaactgtgtctcgatagatatgttgaaataatttttgtaggaatctcctctttggtaggtgctgatgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacatttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcacactgcatttgacacactaagataacttgagtcatgtcggatcctggcctgtgatacttctgcacaatgggattttcattagtgtgagaagctgagcagtatagtctgagaacttttcaccagaagagatcaaagcaggggtagatggccaaaagcaatctcatgagagaggtggaagtcttcacaacagacaaaatgagcactggataggtacacagaaatagagactgggtgccacagcaaggaatgtctcagggtaaaagacacacacacacacacacacacacacacacacacacacacacactaacacagagagagggagagagaggggggttccttccagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttcttcgactgcataggcaaggggacttatgattgcccttgttattggatttttcttactggatgcttggagaagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagaaaagggcatggcatgttcacatccaaggccagagagtaacagcaagtgagatctggaagggcagtgtgaagaggttggtaagagcaggagtgttgagggtgcctgtgagatatgacaagcccatagtacatggtaagcccataatccatgtgcttttccattggtcccactgtaatcggggcatgttctctgtattatcttcacagggttgcattccctttccagtatggtccatggaaaacatgcagaggaaatggccccaccacattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacagctgccattgatatgtccaggcccttcgggacatggagcatgcctagggccctggtttctcccaggtttggagcttcggcccattgttccctggcagtggattggcagtgtccagcagtccattgctctccccaaaaccaaagcactccagagtactggaaccacttgatgcaatgcactccaacgtgcttggatctatgatgattcccagtcaaacattccttggaaaagctgaacaaaatgagtgaaaattctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggactactctgccaaaaatccatggtgtaggacacagcaggtccttaagctctggtggcttgctccctttgctatagtggagatgcttggcagatactcagtaggtagtcgtgctaggtccaaggagagggccccagccattgtggaaagtagactgtgaggcaaaagtagcagtggcagtggcagcaaatcttggcttttcacatgggaatatctggcagtggactcaggcttctcagaagcacttatatgaattttaaccctgttgcattgctttacgtagtcaatagaatgtaggctgctggtagagtgtagcttgacccagtagcatgtaaacgggactgtgtgactgttgtctgttcaggtggtgaacagaaggctctgtgtccctggcagcttggaagtttccctggggattggctaggaaatagagaatgagctaacccttggaggtgatagcaggcacctcacgggtcagtttgcaccacatttacacacttacctgtgtctgtagacggatgaaactttgatggactcgctgggagcatgagacttgcagacctgtgtctccatagatttgttgaaataatttttgtaggaatctcctctttggtaggtgctgttgctttggatgttgttgaagggatatccttggtatatttggaccttgttgtcagcctctttggcaaggtcaaagggaaagtctaggaacagttcttgcacccacagccttaggagaaccatcttggtgagggaccctctaaattagagaccaaggtgtcatgggacctttcttttcgatgttttggcctaactcttcttgaaagacaagttgctagtgtgcataggagggaggtttcaacagggcacatcgtgtttttcaaatccaccttgagagccatgctcatgggaatcatcagggagaaaataagttcttggatgcagactgcacttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacagggggacagaaatagggactgactgccacagcaaggaatgtctcatggtaaaagacacacacacaaacacacacacacacacacactaacacagagagagggagagagagggtggttcctttcagtagtgaaaatgaagcctgcttcccatgagctggaaatctgaactctcagaggagtttgattttacctcatgcaaagacccagaagtaatgatcaaagaaggactggagccatgattgaagactcaaaagttgttggcttagatatccttggaggcccaattttgctggtggagttattcagagctgcctcctccttctttgactgcataggcaaggggacctatgattgcccttgttattggatttttctgactggatgcttggataaaagccttcattcccttgaaaactttgctcaggacactggtggaggaagttgatggcatggacctaagagaaagtgttgagtacctgtattgcaactcacatatcatccttaagtctttagagtgagctgaggacccagcaagcacttgagatcaaagggcatggcatgttcacatccaaggcctgagagtaacagcaagtgagatctggaagggcagtgtgaagaggttggtaagagcaggagtgttgagggtgcctgtgagatatgacaagcccatagtacatggtgagcccataatccatgtggttttgcattggtcccactgtaattggggcatgttctctgtgttgtcttcacagggttgcattccctttccagtatggtccatggaaaacatgcagaggaaatggccccacagcattggctgagtgtttatgtcgtgcaactgagtctccatcgaactgttgtggtgttgctgacttgccctaggtcacctgagttaaatggtaaggaacatgggatctgctgcatgaattctaggtgcccaggtcttggtggagcagggaatggctgccattgattatgtccaggcccttcgggacatggagcatgcctaggtcctctggtttctcccatgtttggagcttcggcccattgttccctggcagtggattgtcagtgtccagcagtccattgctctcgccaaagccagagcactccagagtactggaaccacttgatgcaatgcactccaactagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggactactctgccaaaaatccatggtgtaggacacagcaggtccttaagctctggtggcttgctccctttgctatagtggagatgcttggcagatactcagtaggtagtcgtgctaggtccaaggagagggccccagccattgtggaaagtagactgtgaggcaaaagtagcagtggcagtggcagcaaatcttggcttttcacatgggaatatctggcagtggactcaggcttctcagaagcacttatatgaattttaaccctgttgcattgctttacgtagtcaatagaatgtaggctgctggtagagtgtagcttgacccagtagcatgtaaacgggactgtgtgactgttgtctgttcaggtggtgaacagaaggctctgtgtccctggcagcttggaagtttccctggggattggctaggaaatagagaatgagctaacccttggaggtgatagcaggcacctcacgggtcagtttgcaccacatttacacacttacctgtgtctgtagacggatgaaactttgatggactcgctgggagcatgagacttgcagacctgtgtctccatagatttgttgaaataatttttgtaggaatctcctctttggtaggtgctgttgctttggatgttgttgaagggatatccttggtatatttggaccttgttgtcagcctctttggcaaggtcaaagggaaagtctaggaacagttcttgcacccacagccttaggagaaccatcttggtgagggaccctctaaattagagaccaaggtgtcatgggacctttcttttcgatgttttggcctaactcttcttgaaagacaagttgctagtgtgcataggagggaggtttcaacagggcacatcgtgtttttcaaatccaccttgagagccatgctcatgggaatcatcagggagaaaataagttcttggatgcagactgcacttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaagagcactggacagggggacagaaatagggactgactgccacagcaaggaatgtctcatggtaaaagacacacacacaaacacacacacacacacactaacacagagagagggagagagaggggggttcctttcagtagtgaaaatgaagcctgcttcccatgagctggaaatctgaactctcagaggagtttgattttacctcatgcaaagacccagaagtaatgatcaaagaaggactggagccatgattgaagactcaaaagttgttggcttagatatccttggaggcccaattttgctggtggagttattcagagctgcctcctccttctttgactgcataggcaaggggacctatgattgcccttgttattggatttttctgactggatgcttggagaaaagccttcattcccttgaaaactttgctcaggacactggtggaggaagttgatggcatggacctaagagaaagtgttgagtacctgtattgcaactcacatatcatccttaagtctttagagtgagctgaggacccagcaagcacttgagatcaaagggcatggcatgttcacatccaaggcctgagagtaacagcaagtgagatctggaagggcagtgtgaagaggttggtaagagcaggagtgttgagggtgcctgtgagatatgacaagcccatagtacatggtgagcccataatccatgtggttttgcattggtcccactgtaattggggcatgttctctgtgttgtcttcacagggttgcattccctttccagtatggtccatggaaaacatgcagaggaaatggccccacagcattggctgagtgtttatgtcgtgcaactgagtctccatcgaactgttgtggtgttgctgacttgccctaggtcacctgagttaaatggtaaggaacatgggaattgctgcatgaattctaggtgcccaggtcttggtggagcagggaatggctgccattgattatgtccaggcccttcgggacatggagcatgcctaggtcctctggtttctcccatgtttggagcttcggcccattgttccctggcagtggattgtcagtgtccagcagtccattgctctcgccaaagccagagcactccagagtactggaaccacttgatgcaatgcactccaactagcttggatctatgatgattcccagtcaaacattccttggaaaagctgaacaaaatgagtgaaaactctgtaccgtcactctcatcggaactgaggtccagcatcttgggtctcccaggtgctatgggcgtcaggcacaggctgcccaaatactccattgttcttgacttcttcgggctctagccagaccctccagaggcaggtgtgtgcttggcctactctgccaaaaatccaaggcataggacagagaacgtccttaagctctggtggcttgctccctttgctttagtggagatgcttggcagatactcagtaggtagtcgtgctaggtccaaggagagggccccagccattgtggaaagtagactgtgaggaaaagtagcagtggcagtggcaccaaatcttggcttttcacatgggaatatcaagcagtggactcaggcttctcagaagcacttatatgaattttaaccctgttgcattgctttacttaatcaatagaatgcaggctgctggtagagtgtagcttgacccagtagcatgtaaacgggactgtatgactgttgtcggtacaggtggtgaacagaaggctctgtttcccttgcagcttggaagtttccagggggattggctaggaaatagaggaggagctatcctttggaggtgatggcaggcacctcacgggtcagtttgcaccacatttacacacttacctgtgtctgtagacggatgaaactttgatggactcgctggcagcatgagacttgcagacctgtgtctcgatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacatttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcatgtcggatcctggcctgtgatacttctgcacaatggtattttcattagtgtgagaagctgagcagtatagtctgagaacttttcaccagaagagatcaaagcaggggtagatggccaaaagcaatctcatgagagaggtggaagtcttcacaacagacaaaatgagcactggataggtacacagaaatagagactgggtgccacagcaaggaatgtctcagggtaaaagagacacacacacacacacacacacacatacacacacacacacacacacacacacacacactaacacagagagagggagagagaggggggttcctttcagctgtgaaaatgaagcctgcctcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggacttattcagagctgcctccttcttcttcgtcagcataggcaaggggacctatgattgcccttgttattggctttttctgactggatgcttggagaagagccttcattcccttgaaaactttgctcaggacactggtggaagaagttgatggcatggacgtaagagaaagtgttgagtacctgtattgcagctcacatatcatccttaagtccttagagtgagctgaggacccagcaagcacttgagagcaaagggcatggcatgttcacatccaaggcctgagagtaacagcaagtgagatctggaagggcagtgcgaagaggttggtaagagcaggagtgttgagggtgcccatgagacatgacaagcccatagtacatggtaagcccataatccatgtggttttgcattgttcccactctaatcggggcattttctctgtgctgtcttcacagggttgcattccctttccagtatggtccatggaaaacagcagaggaaatggccccacagcattggctgagtgtttatgtcgtgcaactgagtctccatcgaactgttgtggtgttgctgacttgccctaggtcacctgagttaaatggtaaggaacatgggaattgctgcatgaattctaggtgcccaggtcttggtggagcagggaatggctgccattgattatgtccaggcccttcgggacatggagcatgcctaggtccctggtttctcccatgtttggagcttcggcccattgttccctggcagtggattgtcagtgtccagcagtccattgctctcccctaagccagagcactccagagtactggaaccacttgatgcaatgcactccaaggtgcttggatctatgatgattcccagtcaaacattccttggaaaagctgaacaaaatgagtgaaactctgtaccgtcactctcatcggaactgaggtccagcatcttgggtctcctaggtgctatgggcgtcaggcacaggctgcccaaacactccattgttcttgacttcttcgggctctagccagactctccagaggcaggtgtgtgcttggactactctgccaaaaatccaaggcataggacagagaacgtccttaagcactggtggcttgctccctttgctgtagtggagatgcttggcagatactcagtaggtagtcgtgctaggtccaaggagagggccccagccattgtggaaagtagactgtgaggaaaagtagcagtggcagtggcaccaaatcttggcttttcacatgggaatatcaagcagtggactcaggcttctcagaagcacttatatgaattttaaccctgttgcattgctttacttaatcaatagaatgcaggctgctggtagagtgtagcttgacccagtagcatgtaaacgggactgtatgactgttgtcggttcaggtggtgaacagaaggctctgtgtcccttgcagcttggaagtttcccgggggattggctaggaaatagaggaggagctatcctttggaggtgatggtaggcacctcacgggtcagtttgcaccacatttacacacttacctgtgtctgtagacggatgaaactttgatggactcgctggcagcatgagacttgcagacctgtgtctcgatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacatttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcatgtcggatcctttgcctgtgatacttctgcacaatgggattttcattagtgtgagaagctgagcagtatagtctgagaacttttcaccagaagagatcaaagcaggggtagatggccaaaagcaatctcatgagagaggtggaagtcttcacaacagacaaaatgagcactggataggtacacagaaatagagactgggtgccacagcaaggaatgtctcagggtaaaagacacacacacacacacacacacatacacacacacacacacacacacacacacacacacacacactaacacagagagagggagagagaggggggttcctttcagctgtgaaaatgaagcctacttcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggacttattcagagctgcctccttcttcttcgtcagcataggcaaggggacctagattgcccttgttattggctttttctgactggatgcttggagaagagccttcattcccttgaaaactttgctcaggacactggtggaagaagttgatggcatggacgtaagagaaagtgttgagtacctgtattgcagctcacatatcatccttaagtccttagagtgagctgaggacccagcaagcacttgagagcaaaggcatggcatgttcacatccaaggcctgagagtaacagcaagtgagatctggaagggcagtgcgaagaggttggtaagagcaggagtgttgagggtgcctgtgagatatgacaagcccatagtacatggtaagcccataatccatgtggttttgcattggtcccaatgtaattggggcatgttctctgtgctgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtattggtggagcagggaatggctgccattgattatgcccaggcccttcgtgacatggagcatgcctagggcctctggtttctcccatgtttggagcttcggcccattgttccctggcagtggattgtcagtgtccagcagtccattgctctccccaaagccagagcactccagagtactggaaccacttgatgcaatgcactccaaggtgcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaacactccattgttcttgacttcttcgggctctagccagactctccagaggcaggtgtgtgcttggactactctgccaaaaatccaaggcataggacagagaacgtccttaagctctggtggcttgctccctttgctgtagtggagatgcttggcagatactcagtaggtagtcatgctaggtccaaggagagggccccagccattgtggaaagtagactgtgaggaaaagtagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtagcatgtaaacgggactgtgtgactgttgtcggttcaggtggtgaacagaaggctctgtgtcccttgcagcttggaagtttcccgggggattggctaggaaatagaggaggagctagcctttggaggtgatggcaggcacctcacgggtcagtttgcaccacatttacacacttacatgtgtctgtagacggatgaaactttgatggactcgctggcagcatgagacttgcagaactgtgtctcgatagatatgttgaaataatttttgtaggaatctcctctttggtaggtgctgatgctttggatgttgttgaagggatatccttggtatatttggaccttgttgtcagcctccttggcaaggtcaaagggaaagtctaggaacagtttttgcacccacagccttaggagaaccatcttggtgagggaccctctaaattagagaccaaggtgtcatgggacatttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcacactgcatttgacacactaagataacttgagtcatgtcggatcctggcctgtgatacttctgcacaatgggattttcattagtgtgagaagctgagcagtatagtctgagaacttttcaccagaagagatcaaagcaggggtagatggccaaaagcaatctcatgagagaggtggaagtcttcacaacagacaaaatgagcactggataggtacacagaaatagagactgggtgccacagcaaggaatgtctcagggtaaaagacacacacacacacacacacacacacacacacacactaacacagagagagggagagagaggggggttccttccagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttcttcgactgcataggcaaggggacttatgattgcccttgttattggatttttcttactggatgcttggagaagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagaaaagggcatggcatgttcacatccaaggccagagagtaacagcaagtgagatctggaagggcagtgtgaagaggttggtaagagcaggagtgttgagggtgcctgtgagatatgacaagcccatagtacatggtaagcccataatccatgtgcttttccattggtcccactgtaatcggggcatgttctctgtattatcttcacagggttgcattccctttccagtatggtccatggaaaacatgcagaggaaatggccccaccacattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacagctgccattgatatgtccaggcccttcgggacatggagcatgcctagggccctggtttctcccaggtttggagcttcggcccattgttccctggcagtggattggcagtgtccagcagtccattgctctccccaaaaccaaagcactccagagtactggaaccacttgatgcaatgcactccaacgtgcttggatctatgatgattcccagtcaaacattccttggaaaagctgaacaaaatgagtgaaaattctgtaccgccactctcatcggaactgaggtccagcatcttgggtctcccaggtgctatgggcgtcaggcacaggctgcccaaccactccattgttcttgacttcttcgggctctagccagactctccagagacaggtgtgttcttggactactctgccaaaaatccatggtgtaggacacagcaggtccttaagctctggtggcttgctccctttgctatagtggagatgcttggcagatactcagtaggtagtcgtgctaggtccaaggagagggccccagccattgtggaaagtagactgtgaggcaaaagtagcagtggcagtggcagcaaatcttggcttttcacatgggaatatctggcagtggactcaggcttctcagaagcacttatatgaattttaaccctgttgcattgctttaagtagtcaatagaatgtaggctgctggtagagtgtagcaagacccagtagcatgtaaacgggactgtgtgactgttgtctgttcaggtggtgaacagaaggctctgtgtccctggcagcttggaagtttccctgggtattggctaggaaatagagaatgagctaacccttggaggtgatagcaggcacctcacgggtcagtttgcaccacatttacacacttacctgtgtctgtagacggatgaaactttgatggactcgctgggagcatgagacttgcagacctgtgtatccatagatttgttgaaataatttttgtaggaatctcctctttggtaggtgctgttgctttggatgttgttgaagggatatccttggtatatttggaccttgttgtcagcctctttggcaaggtcaaagggaaagtctaggaacagttcttgcacccacagccttaggagaaccatcttggtgagggaccctctaaattagagaccaaggtgtcatgggacctttcttttcgatgttttggcctaactcttcttgaaagacaagttgctagtgtgcataggagggaggtttcaacagggcacatcgtgtttttcaaatccaccttgagagccatgctcatgggaatcatcagggagaaaataagttcttggatgcagactgcacttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacagggggacagaaatagggactgactgccacagcaaggaatgtctcatggtaaaagacacacacacaaacacacacacacacacactaacacagagagagggagagagaggggggttcctttcagtagtgaaaatgaagcctgcttcccatgagctggaaatctgaactctcagaggagtttgattttacctcatgcaaagacccagaagtaatgatcaaagaaggactggagccatgattgaagactcaaaagttgttggcttagatatccttggaggcccaattttgctggtggagttattcagagctgcctcctccttctttgactgcataggcaaggggacctatgattgcccttgttattggacttttctgactggatgcttggagaaaagccttcattcccttgaaaactttgctcaggacactggtggaggaagttgatggcatggacctaagagaaagtgttgagtacctgtattgcaactcacatatcatccttaagtctttagagtgagctgaggacccagcaagcacttgagatcaaagggcatggcatgttcacatccaaggcctgagagtaacagcaagtgagatctggaagggcagtgtgaagaggttggtaagagcaggagtgttgagggtgcctgtgagatatgacaagcccatagtacatggtgagcccataatccatgtggttttgcattggtcccactgtaattggggcatgttctctgtgttgtcttcacagggttgcattccctttccagtatggtccatggaaaacatgcagaggaaatggccccacagcattggctgagtgtttatgtcgtgcaactgagtctccatcgaactgttgtggtgttgctgacttgccctaggtcacctgagttaaatggtaaggaacatgggaattgctgcatgaattctaggtgcccaggtcttggtggagcagggaatggctgccattgattatgtccaggcccttcgggacatggagcatgcctaggtcctctggtttctcccatgtttggagcttcggcccattgttccctggcagtggattgtcagtgtccagcagtccattgctctcgccaaagccagagcactccagagtactggaaccacttgatgcaatgcactccaactagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggactactctgccaaaaatccatggtgtaggacacagcaggtccttaagctctggtggcttgctccctttgctatagtggagatgcttggcagatactcagtaggtagtcgtgctaggtccaaggagagggccccagccattgtggaaagtagactgtgaggcaaaagtagcagtggcagtggcagcaaatcttggcttttcacatgggaatatctggcagtggactcaggcttctcagaagcacttatatgaattttaaccctgttgcattgctttacgtagtcaatagaatgtaggctgctggtagagtgtagcttgacccagtagcatgtaaacgggactgtgtgactgttgtctgttcaggtggtgaacagaaggctctgtgtcccttgcagcttggaagtttccctggggattggctaggaaatagagaatgagctaacccttggaggtgatagcaggcacctcacgggtcagtttgcaccacatttacacacttacctgtgtctgtagacggatgaaactttgatggactcgctgggagcatgagacttgcagacctgtgtctccatagatttgttgaaataatttttgtaggaatctcctctttggtaggtgctgttgctttggatgttgttgaagggatatccttggtatatttggaccttgttgtcagcctctttggcaaggtcaaagggaaagtctaggaacagttcttgcacccacagccttaggagaaccatcttggtgagggaccctctaaattagagaccaaggtgtcatgggacctttcttttcgatgttttggcctaactcttcttgaaagacaagttgctagtgtgcataggagggagatttcaacagggcacatcgtgtttttcaaatccaccttgagagccatgctcatgggaatcatcagggagaaaataagttcttggatgcagactgcacttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacagggggacagaaatagggactgactgccacagcaaggaatgtctcatggtaaaagacacacacacaaacacacacacacacacactaacacagagagagggagagagaggggggttcctttcagtagtgaaaatgaagcctgcttcccatgagctggaaatctgaactctcagaggagtttgattttacctcatgcaaagacccagaagtaatgatcaaagaaggactggagccatgattgaagactcaaaagttgttggcttagatatccttggaggcccaattttgctggtggagttattcagagctgcctccaccttctttgactgcataggcaaggggacctatgattgcccttgttattggatttttctgactggatgcttggagaaaagccttcattcccttgaaaactttgctcaggacactggtggaggaagttgatggcatggacctaagagaaagtgttgagtacctgtattgcaactcacatatcatccttaagtctttagagtgagctgaggacccagcaagcacttgagatcaaagggcatggcatgttcacatccaaggcctgagagtaacagcaagtgagatctggaagggcagtgtgaagaggttggtaagagcaggagtgttgagggtgcctgtgagatatgacaagcccatagtacatggtgagcccataatccatgtggttttgcattggtcccactgtaattggggcatgttctctgtgttgtcttcacagggttgcattccctttccagtatggtccatggaaaacatgcagaggaaatggccccacagcattggctgagtgtttatgtcgtgcaactgagtctccatcgaactgttgtggtgttgctgacttgccctaggtcacctgagttaaatggtaaggaacatgggaattgctgcatgaattctaggtgcccaggtcttggtggagcagggaatggctgccattgattatgtccaggcccttcgggacatggagcatgcctaggtcctctggtttctcccatgtttggagcttcggcccattgttccctggcagtggattgtcagtgtccagcagtccattgctctcgccaaagccagagcactccagagtactggaaccacttgatgcaatgcactccaactagcttggatctatgatgattcccagtcaaacattccttggaaaagctgaacaaaatgagtgaaaactctgtaccgtcactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggcgtaggacacagcaggtccttaatctctggtggcttgctccctttgctgtagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatcaagcagtggaggcaggcttctcagaagcacttatatgaattttaaccctgttgcattgctttacttattcaatagaatgcaggctgctggtagagtgtagcttgacccagtaacatgtaaatgtgactgtgtgactgttgttggttcaggtggtgaacagaaggctctgtgtccctggcagcttggaagtttcccgggcgattggctaggaaatagaggaggagctaacctttggaggtgatggcaggcacctcacgggtcagtttgcaccacatttacacacttacctgtgtctgttgacggatgaaactttgatggactcgctgggagcatgagacttgcagacctgtgtctccatagatttgttgaaataatatttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgttcataggagggaggtttcaacagggcacatcgtgttttgcaaatccacgttgagagccatgctcatgggaatcatcagggagaaaataagttcttggatgcagactgcatttgacacactaagataacttgagtcaagttggatcctggcctgtgatagttctgcacaatgggattttcattagcgtgagaagcagagcagtatagtctgagaacttttcaccagaagagatcaaagcagggttggatggccaaaagcaatctcatgagagaggtggaagtcttcacaacagacaaaatgagcactggataggtggacagaaatagagactggctgccacagcaaggaatgtctcagggtaaaagacacacacacacacacacacacacacacacacacacacacacactaacacagagagagggagagagaggggggttccttccagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttcttcgactgcataggcaaggggacttatgattgcccttgttattggatttttcttactggatgcttggagaagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagaaaagggcatggcatgttcacatccaaggccagagagtaacagcaagtgagatctggaagggcagtgtgaagaggttggtaagagcaggagtgttgagggtgcctgtgagatatgacaagcccatagtacatggtaagcccataatccatgtgcttttccattggtcccactgtaatcggggcatgttctctgtattatcttcacagggttgcattccctttccagtatggtccatggaaaacatgcagaggaaatggccccaccacattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacagctgccattgatatgtccaggcccttcgggacatggagcatgcctagagccctggtttctcccaggtttggagcatcggcccattgttccctggcagtggattggcagtgtccagcagtccattgctctccccaaaaccaaagcactccagagtactggaaccacttgatgcaatgcactccaacgtgcttggatctatgatgattcccagtcaaacattccttggaaaagctgaacaaaatgagtgaaaattctgtaccgccactctcatcggaactgaggtccagcatcttgggtcttccaggtgctatgggcgtcaggcacaggctgcccaaacactccattgttcttgacttcttcgggctctagtcagactctccagagacaggtgtgtgcttggactactctgccaaaaatccatggtgtaggacacagcaggtccttaagctctggtggcttgctccctctgctatagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatctggcagtggactcaggcttctcagaagcacttatatgaattttaaccctgttgcattgctttacgtagtcaatagaatgtaggctgctggtagagtgtagcttgacccagtagcatgtaaacgggactgtgtgactgttgtctgttcaggtggtgaacagaaggctctgtgtccctggcagcttggaagtttccctggggattggctaggaaatagagaatgagctaacccttggaggtgatagcaggcacctcacgggtcagtttgcaccacatttacacacttacctgtgtctgtagacggatgaaactttgatggactcgctgggagcatgagacttgcagacctgtgtctccatagatttgttgaaataatttttgtaggaatctcctctttggtaggtgctgttgctttggatgttgttgaagggatatccttggtatatttggaccttgttgtcagcctctttggcaaggtcaaagggaaagtctaggaacagttcttgcacccacagccttaggagaaccatcttggtgagggaccctctaaattagagaccaaggtgtcatgggacctttcttttcgatgttttggcctaactcttcttgaaagacaagttgctagtgtgcataggagggaggtttcaacagggcacatcgtgtttttcaaatccaccttgagagccatgctcatgggaatcatcagggagaaaataagttcttggatgcagactgcacttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacagggggacagaaatagggactgactgccacagcaaggaatgtctcatggtaaaagacacacacacaaacacacacacacacacactaacacagagagagggagagagaggggggttcctttcagtagtgaaaatgaagcctgcttcccatgagctggaaatctgaactctcagaggagtttgattttacctcatgcaaagacccagaagtaatgatcaaagaaggactggagccatgattgaagactcaaaagttgttggcttagatatccttggaggcccaattttgctggtggagttattcagagctgcctccaccttctttgactgcataggcaaggggacctatgattgcccttgttattggatttttctgactggatgcttggagaaaagccttcattcccttgaaaactttgctcaggacactggtggaggaagttgatggcatggacctaagagaaagtgttgagtacctgtattgcaactcacatatcatccttaagtctttagagtgagctgaggacccagcaagcacttgagatcaaagggcatggcatgttcacatccaaggcctgagagtaacagcaagtgagatctggaagggcagtgtgaagaggttggtaagagcaggagtgttgagggtgcctgtgagatatgacaagcccatagtacatggtgagcccataatccatgtggttttgcattggtcccactgtaattgggacatgttctctgtgctgtcttcacagggttgcattccctttccagtatggtccatggaaaacatgcagaggaaatggcctcacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaatggctgccattgattatatccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgatgcaatgcactccaacgagcttggatctatgatgattcccagtcaaacattccttggaaaagctgaacaaaatgagtgaaaactctgtaccgccactctcatctgaactgaggtccagcatcttgggtctcccaggtgctgtgggcgtcaggcacaggctgcccaaccactccattgttcttgacttcttcgggctctagccagactctccagagacatgtgtgtgcttggcctactctgccaaaaatccatggcgtaggacacagcaggtccttaagctctggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggaggcaggcttctcagaagcacttatatgaattttaaccctgttgcattgctttacttaatcaatagaatgcaggctgctggtagagtgtagcttgacccagtagcatgtaaatgggactgtgtgactgttgtcggttcaggtggtgtacagaagtctctgtgtccctggcagcttggatgtttccccggggggttgctaggaaatagagaaggagctaagccttggaggtgatggcaggcacctcacgggtcagtttgcaccacatttacacacttacctgtgtctgtagacagatgaaactttgatggactcgctgggagcatgagacttgcagacctgtgtctccatagatttgttgaaataatttttgtaggaatctcctctttggtaggtgctgttgctttggatgttgttgaagggatatccttggtatatttggacattgttgtcagcctccttggcaaggtcaaaggaaagtctaggaatagttcttgcacccacagccttaggagaaccatcttggtgagggaccctataaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcaggaagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaggcaatctcatgagagaggtggaagtcttcacaacagacaaaatgagcactggacaggtggacagaaatagggactggctgccacagcaaggaatgtctgagggtaaaagacacacacacacacacacacacacacacacacacacacacacacacacactaacacagagagagggagagagaggggtttcctttcagctgtgaaaatgaagcctgcttcccatgagctggaattctgaactctcagaggagtttgattttacctcatgcaaaaacccagaagtaatgatcagagaaatactggagccatgattgaaggctcaaaagttgttggcttagatatcctggaggcccaattttgctggtggagttattcagagctgcctcctccttcttcgactgcataggcaaggggacctatgattgcccttgttattggctttttctgactgcatgcttggagaagagccttcattcccttgaaaactttgctcaggacactggtggaggaagttgatggcatggatctaagagaaagtgttgagtacctgtattgcagctcacatatcatccttaagtccttagagtgagctgaggacccagcaagcacttgagagcaaagggcatggcatgttcacattcaaggcctgagagtaacagcaagttagatctggaagggcagtttgaagaggatggtaagagcaggagtgttgagggtgcctgtgagatatgacaagcccatagtacatggtaagcccataatccatgtggtattgcattggtcccactgtaatcggggcatgttctttgtgttgtcttcacagggttgcattccctttccagtatggtccatggaaaacatgcagaggaaatggccccacagcattggctgagagtttatgtcgtccaactgagtctacattgaactgttgtggtgttgctgacttgccctaggtcacctgagttaaatggtaaggaacatgggaattgctgcatgaattctaggtgcccaggtcttggtggagcagggaacggctgccattgattatgcccaggcccttcgggacatggagcatgcctagggcctctggtttctcccatgtttggagcttcggcccattgttccctggcagtggattgtcagtgtccagcagtccattgctctccccaaagccagagcactccagagtactggaaccacttgatgcaatgcgctccaacgagcttggatctatgatgattcccagtcaaacattccttggaaaagctgaacaaaatgagtgaaaactctgtaccgtcactctcatcggaactgaggtccagcatcttgggtctcccagttgctatgggcgtcaggcacaggctgcccaaacactccattgttcttgacttcttcgggctctagccagactctccagagacaggtgtgtgcttggcctactctgccaaaaatccatggtgtaggacacagcaggtccttaagcactggtggcttgctccctttgctgtagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatcaagcagtggaggcaggcttctcagaagcacttatatgaattttaaccctgttgcattgctttacgtagtcaatagaatgcaggctgctggtagagtgtagcttgaccgagaagcacgtaaacgggactgtgtgactgttgtcggttcaggtggtgaacagaaggctctgtgtccctggcagcttggaagtttcccgggcgattggcttggaaatatagaaggagctaagccttggaggtgatggcaggcacctcacgggtcagtttgcaccacatttacacacttacctgtgtctgtagacggatgaaactttgatggactcgctgggagcatgagacttgcagacctgtgtctccatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctataaattagagaccaaggtgtcatgggacctttcttttcgatgttttggcctaactcttctggaaagacaagttgctagtgtgcataggaaggaggtttcaacagggcacatcgtgttttgcaaatccaccttgagagccatggtcatgggaatcatcagggagaaaataagttcttggatgcagactgcatttgacacactaagataacttgagtcaagtcggatcctggcctgtgatacttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacttacacagagagagggagagagaggggggttcctttcagctgtgaaaatgaagcttgcttcccatgagctggaattctgaactctcagaggagtttgattttacctcatgcaaagacccagaagtaatgatcactgaaggactggagccatgattgaaggctcaaaagttgttggcttagatatccttgtaggtccaatattgctggtggagttattcagagctgcctcctccttcttcgactgcataggcaaggggacctatgattgcccttgttattggctttttctgactccatgcttggagaagagccttcattcccttgaaaactatgctcaggacactggtggaggaagttgatggcatggacctaagagaaagtattgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctttgtgttgtcttcacagggttgcattccctttccagtatggtccatggaaaacatgcagaggaaatggccccacagcattggctgagagtttatgtcctccaactgagtctccattgaactgttgtggtgttgctgacttgccctaggtcacctgagttaaatggtaaggaacatgggaattgctgcatgaattctaggtgcccaggtcttggtggagcagggaacggctgccattgattatgcccaggcccttagggacatggagcatgcctagggcctctggtttctcccatgtttggagcttcggcccattgttccctggcagtggattgtcagtgtgcagcagtccattgctctcccgaaagccagagcaatccagagtactggaaccacttgatgcaatgcactccaacgagcttggatctatgatgattcccagtcaaacattccttggaaaagctgaacaaaatgagtgaaaactctgtaccgccactctcatcagaactgaggtccagcatcttgggtctcccaggtgctatgggcgtcaggaacaggctgcccaaacactccattgttcttgacttcttcgggctctagccagactctccagagacaggtgtgtgcttggcctactctgccaaaaatccatgttgtaggacacagcaggtccttaagcactggtggcttgctccctttgctgtagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatcaagcagtggaggcaggcttctcagaagcacttatatgaattttaaccctgttgcattgctttatgtagtcaatagaatgcaggctgctggtagagtgtagcttgactcagtagcatgtaaacgggactgtgtgactgttgtcggttcaggtggtgaacagaaggctctgtgtccctggcagcatggaagtttcccgggcgattggctaggaaatagaaaaggagctaagccttggaggtgatggcaggcacctcacgtgtcagtttgcaccacatttacacacttacctgtgtctgtagacggatgaaactttgatggactcgctgggagcatgagacttgcagacctgtgtctccatagatttgttgaaataatttttgtaggaatctcctctttggtaggtgctgttgctttggatgtttttgaagggatatccttggtatatttggaccttgttgtcagcctctttggcaaggtcaaagggaaagtctaggaacagttcttgcacccacagccttaggagaaccatcttggtgagggaccctctaaattagagaccaaggtgtcatgggacctttcttttcgatgttttggcctaactcttctgcaaagacaagttgctagtgtgcataggaaggaggtttcaacagggcacatcgtgttttgcaaatccaccttgagagccatgctcatgggaatcatcagggagaaaataagttcttggatgcagactgcacttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaatagacaaaatgagcactggacaggtggacagaaatagggactggctgccacagcaaggaatgtctcagggtaaaagacacacacacacacacacacacacacacacacacacacacacacacacacacactaacacagagagggagagagaggggggttcctttcagctgtgaaaatgaagcctgcttcccatgagctggaattctgaactctcagaggagtttgattttacctcatgcaaagacccagaagtaatgatcagagaaggactggagccatgattgaatactcaaaagttgttggcttagatatccttggaggcccaattttgctggtggagttattgagagctgcctcctccttcttcgactgcataggcaaggggacctatgattgcccttgttattggctttttctgactgcatgcttggagaagagccttcattcccttgaaaactatgctcaggacactggtggaggaagttgatggcatggacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagaagttggtaagagcaggagtgttgagggtgcctgttagatatgacaagcccatagtacatggtaagcccataatccatgtggttttgcattggtcccactgtaatcggggcatgttctttgtgttgtcttcacagggttgcattccctttccagtatggtccatggaaaacatgcagaggaaatggccccacagcattggctgagagtttatgtcgtccaactgagtctccattgaaatgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgttgcaatgcactccaacgagcttgaatctatgatgattcccagtcaaacattccttggaaaatctgaacaaaatgagtgaaaactctgtaccgccactctcatcagaactgaggtccagcatcttgggtctcccaggtgctatgggcgtcaggaacaggctgcccaaacactccattgttcttgacttcttcgggctctagccagactctccagagacaggtgtgtgcttggcctactctgccaaaaatccatgttgtaggacacagcaggtccttaagcactggtggcttgctccctttgctgtagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatcaagcagtggaggcaggcttctcagaagcacttatatgaattttaaccctgttgcattgctttaagtagtcaatagaatgcaggctgctggtagagtgtagcttgacccagtagcatgtaaacgggactgtgtgactgttgtcagttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagacggatgaaactttgatggactcgctgggagcatgagacttgcagacctgtgtctccatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgatttggcctaactcttctggaaagacaagttgctagtgtgcataggaaggaggtttcaacagggcacatcgtgttttgcaaatccaccttgagagccatgttcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtgatggccaaaagcaatctcatgagagaggtggaagtcttcacaacagacaaaatgagcactggacaggtggacagaaatagtgactggctgccacagcaaggaatgtctcagggtaaaagacacacacacacacacacacacacacacacacacacacacacacacacacacactaacacagagagagggagagagaggggggttcctttcagctgtgaaaatgaagcctgcttcccatgagctggaattctgaactctcagaggagtttgattttacctcatgcaaagacccagaagtaatgatcagaaaggactggagccatgattgaaggctcaaaagttgttggcttagatatccttggaggcccaattttgctggtggagttattcagagctgcctcccccttcttcgactgcataggcaaggggacatatgattgcccttgttattggctttttctgactggatgcttggagaagagccttcactctcttgaaaactttgctcaggacactggtggaggaagttgatggcatggacctaagtgaaagtgttgagtacctgtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctttgtgttgccttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatttttggagcttcggcccattgttccctggcagtggattgtcagtgtccagcagtccattgctctccccaaagccagagcaatccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaacactccattgttcttgacttcttcgggctctagccagactctccagagacaggtgtgtgcttggcctactctgccaaaaatccatggtgtaggacacagcaggtccttaagcactggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcacatgggaatatcaagcagtggaggcaggcttctcagaagcacttatatgaattttaaccctgttgcattgctttatgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagatggatgaaactttgatggactcactgggagcatgagacttgcagacctgtgtctccatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctatattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctacacaatgggattttcattagtgtgagaagctgagcagtatagtctgagaacttttcatcagaagagatcaaagcaggggtggatggccaaaagcaatctcaagagagaggtggaagtcttcacaacagacaaaatgtgcactggacatgtggacagaaatagggactggctgccacagcaaggaatgtctcagggtaaaagacacacacacacacacacacacacacacacacacactaacacagagagagggagagagaggggggttcctttcagctgtgaatatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaatattgctggtggagttattcagagctgcctcctccttcttcgactgcataggcatggggaactatgattgcccttgttattggctttttctgactgcatgcttggagaagagccttcattcccttgaaaactatgctcaggacactggtggaggaagttgatggcaaagacctaagagaaagtgttgagtacctgtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagaaggagtgttgagggtgcctgtgagatatgacaagcccatagtacatggtaagcccataatccatgtggttttgcattggtcccactataatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgatgcaatgcactccaacgagcttggatctatgatgattcccagtcaaacattccttggaaaagctgaacaaaatgagtgaaaactctgtaccgccactctcatcggaactgatgtccagcatcttgggtctcccaggtactatgggcgtcaggcacaggctgcccaaccactccattgttcttgacttcttcgggctctagccagactctccagagacaggtgtgtgcttggcctactctgccaaaaatccatggtgtaggacacagcaggtccttatcactggtggcttgctccctttgctgtagtggagatgcttggcagatactcagtaggtagtcgtgctaggtccaaggagagggccccagccattgtggaaagtagactgtgaggcaaaagtagcagtggcagtggcaccaaatcatggcttttcacatgggaatatcaagcagtggaggcaggcttctcagaagcacttatatgaattttaaccctgttgcattgctttacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagacggatgaaactttgatggactcgctgggagcatgagacttgcagacctgtgtctccatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacatcgtgttttgcaaatccacgttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtagaagtcttcacaacagacaaaatgagcactggataggtggacagaaatagagactggctgccacagcaaggaatgtctcagggtaaaagacacacacacacacacacacacacacacacacacacacacacacactaacacagagagagggagagagaggggggttcctttcagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaatattgctggtggagttattcagagctgcctcctccttcttcgactgcataggcaaggggaactatgattgcccttgttattggctttttctgactgcatgcttggagaagagccttaattcccttgaaaactatgctcaggacactggtggaggaggttgatggcaaagacctaagagaaagtgttgagtacctgtattgcagctcacatatcatccttaagtccttagagtgagctgaggacccagcaagcacttgagacaaagggcatggcatgttcacatccaaggcctgagagtaacagcaagtgagatctggaagggcattgtgaagtggttggtaagagcaggagtgttgagggtgcctgtgagatatgagaagcccatagtacatggtaagcccataatccatgtggttttgcattggtcccactgtaatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcaagcctagggcctctgggttttcccatgtttggagcttcggcccattgttccctggcagtggattgtcagtgtccagcagtccattgctatcaccaaagcctgagcactccagagtactggaaccacttgatgcaatgcactccaacgagcttggatctatgatgattgccagtcaaacattccttggaaaagctgaacaaaatgagtgaaaactctgtaccgccactctcatcggaactgaggtccagcatcttgggtctcacatgtgctatgggcgtcaggcacaggctgcccaaacactccattgttcttgacttcttcgggctctagccagactctccagagacaggtgtgtgcttggcctactctgccaaaaatccatggtgtaggacacagcaggcccttaagctctggtggcttgctccctttgctatagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatctggcagtggactcaggcttctcagaagcacttatatgaattttaaccctgttgcattgctttacgtagtcaatagaatgtaggctgctggtagagtgtagcttgacccagtagcatgtaaacgggactgtgtgactgttgtctgttcaggtggtgaaaagaaggctctgtgtccctggcagcttggaagtttcccgggggattggctaggaaatagacaaggagctaagtcttggaggtgatggcaggcacctcacgggtcagtttgcaccacatttacacacttacctgtgtctgtagacggatgaaactgtgatggactcgctgggagcatgagacttgcagacctgtgtctcgatagatttgttgaaataactttggtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcaggggaactttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgcaacagcaaggaatgtctcagggtaaaagacacacacacacacacacacacacacacacacacacacacactaacacagagagagggagagagaggggggttcctttcagctgtgaaaatgaagcctgcttcccatgagctggaattctgaactctcagaggagtttgattttacctcatgcaaagacccagaagtaatgatcagaaaggactggagccatgattgaagactcaaaagttgttggcttagatatccttggaggcccaattttgctggtggagttattcagagctgcctcctccttctttgactgcataggcaaggggacttatgattgcccttgttattggctttttctgactggatgcttggagaagagccttcactctcttgaaaactttgctcaggacactggtggaggaagttgatggcatggacctaagagaaagtgttgagtacctgtattgcttctcacaaaacatccttaagtccttagagtgagctgaggacccagcaagcacttgagagcaaagggcatggcatgttcacaccaaggcctgagagtaacagcaagtgagatctggaagggcagtgtgaagaggttggtaagatcaggagtgttgagggtgcctgtgagatatgacaagcccatagtacatggtaagcccataatccatgggcttttgcattggtcccactgtaatcggggcatgttctctgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcaagcctagggcctctgggttttcccatgtttggagcttcggcccattgttccctggcagtggattgtcagtgtccagcagtccattgctatcaccaaagcctgagcactccagagtactggaaccacttgatgcaatgcactccaacgagcttggatctatgatgattgccagtcaaacattccttggaaaagctgaacaaaatgagtgaaaactctgtaccaccactctcatcggaactgaggtccagcatcttgggtctcacatgtgctatgggcgtcaggcacaggctgcccaaacactccattgttcttgacttcttcgggctctagccagactctccagagacaggtgtgtgcttggcctactctgccaaaaatccatggtgtaggacacagcaggcccttaagctctggtggcttgctccctttgctatagtggagatgcttggcagatactcagtaggtagtcgtgctaggtccaaggagagggccccagccattgtggaaagtagactgtgaggcaaaagtagcagtggtagtggcaccaaatcttggcttttcacatgggaatatcaagcagtggactcaggcttctcagaagcacttatatgaattttaaccctgttgcattgctttacttagtcaatagaatgcaggctgctggtagagtgtagcttgacccagtagcatgtaaatgtgactgtgtgactgttgtcggttcaggtggtgaacagaaggctctgtgtccctggcagcttggaagtttcccgggggattggctaggaaatagaggaggagctaacctttggaggtgatggcaggcacctcacgggtcagttttcaccacatttacacacttacctgtgtctcttgacggatgaaactttgatggactcgctgggagcatgagacttgcagacctgtgtctcaatagatttgttgaaataatttttgtaggaatctcctctttggtaggtgctgttgctttggatgttgttgaagggatatccttggtatatttggaccttgttgtcagcctccttggcaaggtcaaagggaaatgctaggaacagttcttgcacccacagccttaggagaaccatcttggtgagggaccctctaaattagagaccaaggtgtcatgggacctttcttttcgaagttttggcctaactcttcttgaaagacaagtgtctagtgtgcataggagggaggtttcaacggggcacatcgtgttttgcaaatccacgttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggataggtggacagaaatagagactggctgccacagcaaggaatgtctcagggtaaaagacacacacacacacacacacacacacacacacacacacacacacacacactaacacagagagagggagagagaggggggttcctttcagctgtgaaaatgaagcctgcttcccatgagctggaattctgaactctcagcggagtttgattttacctcatgcaaagacccagaagtaatgatcagagaaggactggagccatgattgaaggctctaaagttgctggcttagatatccttggaggcccaattttgctggtggacttattcagagctgcctcctccttctttgtcagcataggcaaggggacctatgattgcccttgttattggcttttttctgattggatgcttggagaagagccttcattcccttgaaaactttgctcaggacactggtggaagaagttgatggcatggacctaagagaaagtgttgagtatcggtattgcagctcacatatcatccttaagtccttagaatgagctgaggacccagcaagcactttagagcaaagggcatggcatgttcacatacaaagcctgagagtaacagcaagtgagatctggaagggcagtgtgaagaggttggtaagagcaggagtgttgagggtgcctgtgagatatgacaagcccatagtacatgttaagcccacaatccatgtggttttgcattggtcccactgtaatcggggcatgttctctgtattgtcttcacagggttgcattccctttccagtatggtccatagaaaacatgcagaggaaatggccccacagcattggctaagagtttatttcgtccaactgagtctccattgaactgttgtggtgttgctgacttgccctaggtcacctgagttaaatggtaaggaacatgggaattgctgcatgaattctaggtgcccaggtcttggtggagcagggaactgctgccattgattatgtccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgatgcaatgcactccaccgagcttggatctatgatgattcccagtcaaacattccttggaaaagctgaacaaaatgagtgaaaactctgtaccgccactctcatcggaactgatgtccagcatcttgggtctcccaggtactatgggcgtcaggaacaggctgcccaaacactccattgttcttgacttcttcgggctctagccagactctccagagacaggtgtgtgcttggcctactctgccaataatccatggtgtaggacacagcaggtccttaagcactggtggcttcctccctttgctgtagtggagatgcttggcagatactcagtaggtagtcatgctaggtccaaggagagggccccagccattgtggaaagtagactgtgaggcaaatgtagcagtggcagtggcaccaaatcttggcttttcacatgggaatatcaagcagtggcctcaggcttctcagaagcacttatatgaattttaaccctgttgtattgctttacgtagtcaatagaatgcaggctgctggtagagtgtagcttgacccagtagcatgtaaacgggactgtgtgactgttgtcagttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagacggatgaaactttgatggactcgctgggagcatgagacttgcagacctgtgtctcgatagatttgttgaaataatttttgtaggaatctcctctttggtaggtgctgttgctttggatgttgttgaagggatatccttggtatatttggaccttgttgtcagcctccatggcaaggtcaaagggaaagtctaggaacagttcttgaccccacagccttaggagaaccatcttggtgagggaccctctaaattagagaccaaggtgtcatggtacctttcttttcgatgttttggcctaactcttcttgaaagacaagttgctagtgtgcataggaaggaggtttcaacagggcacatcgttttttgcaaatccaccttgagagccatgctcatgggaatcatcagggagaaaatacgttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacactaacacagagagagggagagagaggggggttcctttcagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattgagagctgcctcctccttcttcgactgcataggcaaggggacctatgattgcccttgttattggctttttctgactgcatgcttggagaagagccttcactctcttgaaaactttgctcaggacactggtggaggaagttgatggcatggacctaagagaaagtgttgagtacctgtattgcttctcacaaatcatccttaagtccttagagtgagctgaggacccagcaagcacttgagagcaaagggcatggcatgttcacaccaaggcctgagagtaacagcaagtgagatctggaagggcagtgtgaagaggttggtaagatcaggagtgttgagggtgcctgtgagatatgacaagcccatagtacatggtaagcccataatccatgggcttttgcattggtcccactgtaatcggggcatgttctctgtgttgtcttcacagggttgcattccctttccagtatggtccatggaaaacatgcagaggaaatggccccacagcattggctgagtgtttatttcgtacaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcaagcctagggcctctgggttttcccatgtttggagcttcggcccattgttccctggcagtggattgtcattgtccagcagtccattgctatcaccaaagcctgagcactccagagtactggaaccacttgatgcaatgcactccaacgagcttggatctatgatgattgccagtcaaacattccttggaaaagctgaacaaaatgagtgaaaactctgtaccgccactctcatcggaactgaggtccagcccctttggtctcacaggtgctatgggcgtcaggcacaggctgcccaaacactccattgttcttgacttcttcgggctctagccagactctccagagacaggtgtgtgcttggcctactctgccaataatccatggtgtaggacacagcaggtccttaagcactggtggcttactccctttgctgtagtggagatgcttggcagatactcagtaggtagtcctgctaggtccaaggagagggccccagccattgtggaaagtagactgtgaggcaaaagtagcagtggcagtggcaccaaatcttggcttttcacatgggaatatcaagcagtggaggcaggcttctcagaagcacttatatgaattttaactctgttgcgttgctttacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggcgattggctaggaaatagagaaggagctaagccttggggtgatggcagacacctcacgggacagtttgcaccacatttacacacttacctgtgtctgtagacggatgaaactttgatggactcgctgggagcatgagacttgcagacctgtgtctccatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgttcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcctcagaagagatcaaagcaggggtggatggccaaaagcaatctcatgagagaggtggaagtcttcacaacaaacaaaatgagcactggacaggtggacagaaatagggactggctgcaacagcaaggaatgtctcagggtaaaagacacacacacacacacacacacacacacacactaacacagagaaagggagagagaggggggttcctttcagctgtgaaaatgaagcctgcttcccatgagctggaattctgaactctcagaggagtttgattttacctcatgcaaagacccagaagtaatgatcagaaaggactggagccatgattgaaggctcaaaagttgttggcttagatatccttggaggcccaattttgctggtggagttattcagagctgcctcctccttcttcgactgcataggcaaggggatttatgattgcccttgttattggctttttctgactggatgcttggagaagagccttcactctcttgaaaactttgctcaggacactggtggaggaagttgatggcatggacctaagagaaagtgttgagtacctgtattgcttctcacaaatcatccttaagtccttagagtgagctgaggacccagcaagcacttgagagcaaagggcatggcatgttcacaccaaggcctgagagtaacagcaagtgagatctggaagggcagtgtgaagaggttggtaagatcaggagtgttgagggtgcctgtgagatatgacaagcccatagtacatggtaagcccataatccatgggcttttgcattggtcccactgtaatcggggcatgttctctgtgttgtcttcacagggttgcattccctttccagtatggtccatggaaaacatgcagaggaaatggccccacagcattggctgagtgtttatttcgtacaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcaagcctagggcctctgggttttcccatgtttggagcttcggcccattgttccctggcagtggattgtcagtgtccagcagtccattgctatcaccaaagcctgagcactccagagtactggaaccacttgatgcaatgcactccaacgagcttggatctatgatgattgccagtcaaacattccttggaaaagctgaacaaaatgagtgaaaactctgtaccgccactctcatcggaactgaggtccagccccttgggtctcacaggtgctatgggcgtcaggcacaggctgcccaaacactccattgttcttgacttcttcgggctctagccagactctccagagacaggtgtgtgcttggcctactctgccaaaaatccatggtgtaggacacagcaggcccttaagctctggtggcttgctccctttgctatagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatctggcagtggactcaggcttctcagaagcacttatatgaattttaaccctgttgcattgctttacgtagtcaatagaattcaggctgctggtagagtgtagcttgacccagtagcatgtaaactggactgtgtgactgttgtctgttcaggtggtgaaaagaaggctctgtgtccttggcagcttggaagtttccctggggattggctaggaaatagagaatgagctaccccttggaggtgatagcaggcacctcacgggtcagtttgcaccacatttacacacttacctgtgtctgtagacggatgaaactttgatggactcactgggagcatgagacttgcagacctgtgtctcgatagatttgttgaaataatttttgtaggaatctcctctttggtaggtgctgttgctttggatgttgttgaagggatatccttggtatatttggaccttgttgtcagcctctttggcaaggtcaaagggaaagtctaggaacatttcttgcacccacagccttaggagaaccatcttggtgagggaccctctaaattagagaccaaggtgtcatgggacctttcttttcgattttttggcctaactcttcttgaaagacaagttgctagtgtgcataggagggaggtttcaacagggcacatcgtgtttttcaaatccaccttgagagtcatgctcatgggaatcatcagggagaaaataagttcttggatgcagactgcacttgacacactaagataattgagtcaagtcggatcctggcctgtgatagttttgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacaaacacacacacacacacactaacacagagagagggagagagaggggggttcctttcagctgtgaaaatgaagcctgcttcccatgagctggaaatctgaactctcagaggagtttgattttacgtcatgcaaagacccagaagtaatgatcaaagaaggactggagccatgattgaagactcaaaagttgttggcttagatatccttggaggcccaattttgctggtggacttattcagagctgcctcctccttcttcaactgcataggcaaggggacctatgattgcccttgttattggatttttctgactggatgcttggagaaaagccttcattccctagaaaactttgctcaggacactggtggaggaagttgatggcatggacctaagagaaagtgttcagtacctgtattgcaactcacatatcatccttaagcccttagagtgagctgaggacccagcaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgatgcaatgcactccaactagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaacactccattgttcttgacttcttcgggctctagccagactctccagagacaggtgtgtgcttggcctactctgccgaaaatccatggcgtaggacacagcaggtccttaagctctggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcacatgggaatatcaagcagtggactcaggcttctcagaagcacttatatgaattttaaccctgttgcattgctttacttagtcaatagaatgcaggctgctggtagagtgtagcttgacccagtagcatgtaaatgtgactgtgtgactgttgtcggttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagacggatgaaactttgatggactcactgggagcatgagacttgcagacctgtgtctcgatagatttgttgaaataatttttgtaggaatctcctctttggtaggtgctgttgctttggatgttgttgaagggatatccttggtatatttggaccttgttgtcagcctctttggcaaggtcaaagggaaagtctaggaacagttcttgcacccacagccttaggagaaccatcttggtgagggaccctctaaattagagaccaaggtgtcatgggacctttctttttgattttttggcctaactcttcttgaaagacaagttgctagtgtgcataggagggaggtttcaacagggcacatcgtgtttttcaaatccaccttgagagtcatgctcatgggaatcatcagggagaaaataagttcttggatgcagactgcacttgacacactaagataacttgagtcaagtcggatcctggcctgtgatagttttgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacaaacacacacacacacacactaacacagagagagggagagagaggggggttcctttcagctgtgaaaatgaagcctgcttcccatgagctggaaatctgaactctcagaggagtttgattttacctcatgcaaagacccagaagtaatgatcaaagaaggactggagccatgattgaagactcaaaagttgttggcttagatatccttggaggcccaattttgctggtggacttattcagagctgcctcctccttcttcaactgcataggcaaggggacctatgattgcccttgttattggatttttctgactggatgcttggagaaaagccttcattccctagaaaactttgctcaggacactggtggaggaagttgatggcatggacctaagagaaagtgttcagtacctgtattgcaactcacatatcatccttaagcccttagagtgagctgaggacccagcaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccattgtacatggtgagtccataatccatgtggttttgcattggtcccactgtaatcgggacatgttctctgtgttgtcttcacagggttgcattccctttccagtatggtccatggaaaacatgcagaggaaatggcctcacagcattggctgagtgtttatgtcgtccaactgagtctccatcgaactcttgtggtgttgctgacttgccctaggtcacctgagttaaatggtaaggaacatgggaattgctgcatgaattctaggtgcccaggtcttggtggagcagggaatggctgccattgattatgtccaggcccttcgggacaaggagcatgcctaggacctctggtttctcccatgtttggagcttcggcccattgttccctggcagtggattgtcagtgtccagcagtccattgctctccccaaagccagagcaatccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcacatgggaatatcaagcagtggactcaggcttctcagaagcacttatatgaattttaaccctgttgcattgctttacttagtcaatagaatgcaggctgctggtagagtgtagcttgacccagtagcatgtaaatgtgactgtgtgactgttgtcggttcaggtggtgaacagaaggctctgtgtccctggcagcttggaagtttcccgggggattggataggaaatagaggaggagctaacctttggaggtgatggcagccacctcacgggtcagttttcaccacatttacacacttacctgtgtctgttgacggatgaaactttgatggactcgctgggagcatgagacttgcagacctgtgtctcaatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcaggggaactttcttttcgatgttttggcctaactcttctggaaagacaagttgctagtgtgcataggaaggaggtttcaacagggcacatcgtgttttgcaaatccacgttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtagaagtcttcacaacagacaaaatgagcactggataggtggacagaaatagagactggctgccacagcaaggaatgtctcagggtaaaagacacacacacacacacacacacacacacacacacacacacacacacacactaacacagagagagggagagagaggggggttcctttcagctgtaaaaatgaagcctgcttcccatgtgctggaattctgaactctcagcggagtttgattttacctcatgcaaagacccagaagtaatgatcagagaaggactggagccatgattgaaggctcaaaagttgttggcttagatatccttggaggcccaattttgctggtggagttattcagagctgcctcctccttctttgtcagcataggcaaggggacctatgattgcccttgttattggctttttctgattggatgcttggagaagagccttcattcccttgaaaactttgctcaggacactggtggaagaagttgatggcatggacctaagagaaagtgttgagtaccggtattgcagctcacatatcatccttaagtccttagagtgagctgaggacccagcaagcacttgagagcgaagggcatggcatgttcacattcaaggcctgagagtaacagcaagtgagatctggaagggcagtgtgaagaggttggtaagagcaggagtgttgagggtgcctgtgagatatgacaagcccatagtacatggtaagcccataatccatgtggttttgaattggtcccactgtaatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgatgcaatgcactccaacgagcttggatctatgatgattcccagtcaaacattccttggaaaagctgaacaaaatgagtgaaaactctgtaccgccactctcatcggaactgatgtccagcatcttgggtctcccaggtgctatgggcgtcaggaacaggctgcccaaacactccattgttcttgacttcttcgggctctagccagactctccagagacaggtgtgtgcttggcctactctgccaataatccatggtgtaggacacagcaggtccttaagcactggtggcttcctccctttgctgtagtggagatgcttggcagatactcagtaggtagtcgtgctaggaccaaggagagggccccagccattgtggaaagtagactgtgaggcaaaagtagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtagcatgtaaacgggactgtgtgactgttgtcagttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagacggatgaaactttgatggactcgctggcagcatgagacttgcagacctgtgtctcgatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacatcgttttttgcaaatccaccttgagagccatgctcatgggaatcatcagggtgaaaatacgttcttggatgcagactgcatttgacacactaagataacgtgagtcaagtctgatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgcaacagcaaggaatgtctcagggtaaaagacacacacacacacacacacacacacacacacacacacacacacacacactaacacagagagaaggagagagaggggggttcctttcagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttcttcgactgcataggcaaggggacctatgattgcccttgttattggctttttctgactgcgtgcttggagaagagccttcattcccttgaaaactatgctcaggacactggtggaggaagttgatggcatggacctaagagaaagtgttgagtaccagtatagcagctcacatatcatccttaagtccttagagtgagctgaggacccagcaagcacttgagacaaagggcatggcatgttcacatccaaggcctgagagtaacagcaagtgagatctggaagggcagtgtgaagtggttggtaagagcaggagtgttgagggtgcctgtgagatatgacaagcccatagtacatggtaagcccataatccatgtggttttgattggtcccactgtaatcggggcatgttctttgtgttgtctacacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccgtgtttggagcttcggcccattgttccctggcagtggattgtcagtgtccagcagtccattgctctcccgaaagccagagcaatccagagtactggaaccacttgatgcaatgcactccaacgagcttggatctatgatgattcccagtcaaacattccttggaaaagctgaacaaaatgagtgaaaactcggtaccgccactctcatcggaactgaggtccagccccttgggtctcccaggtgctatgggcgtcaggcacaggctgcccaaacactccattcttcttgacttcttcgggctctagccagactctccagagacaggtgtgtgcttggcctactctgccaaaaatccatggtgtaggacagagcaggtccttaagcactggtggcttgctccctttgctgtagtggagatgcttggcagatactcagtaggtagtcctgctaggtccaaggagagggccccagccattgtggaaagtagactgtgaggcaaaagtagcagtggcagtggcaccaaatcttgggctttcacatgggaatatcaagcagtggaggcaggcttctcagaagcacttatatgaattttaaccctgttgcattgctttacgtagtcaatagaatgcaggctgctggtagagtgtagcttgacccagtagcatgtaaacgggactgtgtgactgttgttggtttaggtggtgaacagaaggctctgtgtccctggcagcttggaagtttcccgggagattggctaggaaatagagaaggagctaagccttggaggtgatggcaggcacctcacgtgtcagtttgcaccacatttacacacttacctgtgtctgtagacggatgaaactttgatggactcgctgggagcatgagacttgcagacctgtgtctcgatagatttgttgaaataatttttgtaggaatctcctctttggtaggtgctgttgctttggatgttgttgaagggatatccttggtatatttggaccttgttgtcagccaccttggcaaggtcaaagggaaagtctaggaacagttcttgcacccacagccttaggagaaccatcttgatgagggaccctctaaattagagaccaaggtgtcatgggacctttcttttcgatgttttggcctaactcttctggatagacaagttgctagtgtgcataggatggaggtttcaacagggcacatcgttttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgtgcactggacaggtggacagaaatagggactggctgccacagcaaggaatgtctcagggtaaaagacacacacacacacacacacacacacacacacaaacacagagagagggagagagaggggggttcctttcagctgtgaaaatgaagcctgcttcccatgagctggaattctgaactctcagaggagtttgattttacctcatgcaaagacccagaagtaatgatcagagaaggactggagccatgattgaaggctcaaaatttgttggcttagatatccttggaggcccaattttgctggtggagttattcagagctgcctcctccttcttcgactgcataggcaaggggacctatgattgccttgttattggctttttctgactgcatgcttggagaagagccttcattcccttgaaaactatgctcaggacactggtggaggaagttgatggcatggacctaagagaaagtgttgagtacctgtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaagtcacctgagttaaaaggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccattgctctccccaaagccaaagcaatccagagtactggaaccacttgatgcaatgcactccaacgagcttggatctatgatgattcccagtcaaacattccttggaaaagctgaacaaaatgagtgaaaactcggtaccgccactctcatcggaactgaggtccagccccttgggtctcccaggtgctatgggcgtcaggcacaggctgcccaaacactccattgttcttgacttcttcgggctctagccagactctccagagacaggtgtgtgcttggcctactctgccaaaaatccatggtgtaggacacagcaggtccttaagcactggtggcttgctccctttgctgtagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatcaagcagtggaggcaggcttctcagaagcacttatatgaattttaaccctggtgcattgctttacgtagtcaatagaatgcaggctgctggtagagtgtagcttgacccagtagcatgtaaatgtgactgtgtgactgttgtcggttcaggtggtgaacagaaggctctgtgtccctggcagcttggaagtttcccggcagattggctaggaaatagagaaggagctaagccttggaggtgatggcaggcacctcacgtgtcagtttgcaccacatttacacacttacctgtgtctgtagagggatgaaactttgatggactcgctgggagcatgagacttgcagacctgtgtctcgatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctatattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataatttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacacacactaacacagagagagggagagagaggggggttcctttcagctgtgaaaatgaagcctgcttcccatgagctggaactctgaactctcagaggagtttgactttacctcatgcaaagacccagaagtaatgatcagagaaggactggagccatgattgaaggctcaaaagttgttggcttagatatccttggaggccaaattttgctggtggacttattcagagctgcctcctccttcttcgactgcataggcaaggggacctatgattgcccttgttattggctttttctgactggatgcttggagaagagccttcattcccttgaaaactttgctcaggacactggtggaggaagttgatgacatggacctaagagaaagtgttgagtacctgtattgcagctcacatatcatccttaagtccttagagtgagctgaggacccagcaagcacttgagagcgaagggcatggcatgttcacattcaaggcctgagagtaacagcaagtgagatctggaagggcagtgtgaagaggttggtaagagcaggagtgttgagggtgcctgtgagatatgacaagcccatagtacatggtaagcccataatccatgtggttttgaattggtcccactgtaatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaactgctgcatttgattatgtccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgatgcaatgcactccaacgagcttggatctatgatgattcccagtcaaacattccttggaaaagctgaacaaaatgagtgaaaactctgtaccgccactctcatcggaactgatgtccagcatcttgggtctcccaggtgctatgggcgtcaggaacaggctgcccaaacactccattgttcttgacttcttcgggctctagccagactctccagagacaggtgtgtgcttggcctactctgccaataatccatggtgtaggacacagcaggtccttaagcactggtggcttcctccctttgctgtagtggagatgcttggcagatactcagtaggtagtcgtgctaggaccaaggagagggccccagccattgtggaaagtagactgtgaggcaaaagtagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagactgatgaaactttgatggactcgctggcagcatgagacttgcagacctgtgtctcgatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcagcagggcacatcgtgttttgcaaatccaccttgagagccatgctcatgggaatcatcagggagaaaataagttcttggatgcagactgcatttgacacactaagataacgtgagtcaagtctgatcctggcctgtgatagttctgcacaatgggattttcattagtgtgagaagctgagcagtatagtctgagaacttttcaccagaagagatcaaagcaggggtggatggccaaaataaatctcatgagagaggtgcaagtcttcacaacagacaaaatgagcactggacaggtggacagaaatagggactggctgccacagcaaggaatgtctcagggtaaaagacacacacacacacacacacacacacacacacacacacacacacaaacacagagagagggagagagaggggggttcctttcagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttcttcgactgcataggcaaggggacctatgattgcccttgttattggctttttctgactgcatgcttggagaagagccttcattcccttgaaaactatgctcaggacactggtggaggaagttgatggcatggacctaagagaaagtgttgagtaccagtatagcagctcacatatcatccttaagtccttagagtgagctgaggacccagcaagcacttgagacaaagggcatggcatgttcacatccaaggcctgagagtaacagcaagtgagatctggaagggcagtgtgaagtggttggtaagagcaggagtgttgagggtgcctgtgagatatgacaagcccatagtacatggtaagcccataatccatgtggttttgattggtcccactgtaatcggggcatgttctttgtgttgtctacacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaactgctgcatttgattatgtccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgatgcaatgcactccaacgagcttggatctatgatgattcccagtcaaacattccttggaaaagctgaacaaaatgagtgaaaactcggtaccgccactctcatcggaactgaggtccagccccttgggtctcccaggtgctatgggcgtcaggcacaggctgcccaaacactccattgttcttgacttcttcgggctctaaccagactctccagagacaggtgtgtgcttggcctactctgccaaaaatccatggtgtaggacagagcaggtccttaagcactggtggcttgctccctttgctgtagtggagatgcttggcagatactcagtaggtagtcgtgctaggtccaaggagagggccccagccattgtggaaagtagactgtgaggcaaaagtagcagtggcagtggcaccaaatcttgggctttcacatgggaatatgaagcagtggaggcaggcttctcagaagcacttatatgaattttaaccctgttgcattgctttacgtagtcaatagaatgcaggctgctggtagagtgtagcttgacccagtagcatgtaaacgggactgtgtgactgttgtcggtttaggtggtgaacagaaggctctgtgtccctggcagcttggaagtttcccgggagattggctaggaaatagagaaggagctaagccttggaggtgatggcaggcacctcacgtgtcagtttgcaccacattcacacttacctgtgtctgtagacggatgaaactttgatggactcgctgggagcatgagacttgcagacctgtgtctcgatagatttgttgaaataatttttgtaggaatctcctctttggtaggtgctgttgctttggatgttgttgaagggatatccttggtatatttggaccttgttgtcagccaccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggatagacaagttgctagtgtgcataggatggaggtttcaacagggcacatcgttttttgcaaatccaccttgagagccatgctcatgggaatcatcagggagaaaataagttcttggatgcagactgcatttgacacactaagataacttgagtcaagtcggatcctgtcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgtgcactggacaggtggacagaaatagggactggctgccacagcaaggaatgtctcagggtaaaagacacacacacacacacacacacacacacacacacacacacacacacacacacacacaaacacagagagagggagagagaggggggttcctttcagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttcttcgactgcataggcaaggggacctatgattgccttgttattggctttttctgactgcatgcttggagaagagccttcattcccttgaaaactatgctcaggacactggtggaggaagttgatggcatggacctaagagaaagtgttgagtacctgtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaaaggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgatgcaatgcactccaacgagcttggatctatgatgattcccagtcaaacattccttggaaaagctgaacaaaatgagtgaaaactcggtaccgccactctcatcggaactgaggtccagccccttgggtctcccaggtgctatgggcgtcaggcacaggctgcccaaacactccattgttcttgacttcttcgggctctagccagactctccagagacaggtgtgtgcttggcctactctgccaaaaatccatggtgtaggacacagcaggtccttaagcactggtggcttgctccctttgctgtagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatcaagcagtggaggcaggcttctcagaagcacttatatgaattttaaccctggtgcattgctttacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggagattggctaggaaatagagaaggagctaagccttggaggtgatggcaggcacctcacgtgtcagtttgcaccacatttacacacttacctgtgtctgtagagggatgaaactttgatggactcgctgggagcatgagacttgcagacctgtgtctcgatagatttgttgaaataatttttgtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctatattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataatttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacactcacacacacactaacaaagagagagggagagagaggggggttcctttcagctgtgaaaatgaagcctgcttcccatgagctggaactctgaactctcagaggagtttgactttacctcatgcaaagacccagaagtaatgatcagagaaggactggagccatgattgaaggctcaaaagttgttggcttagatatccttggaggccaaattttgctggtggacttattcagagctgcctcctccttcttcgactgcataggcaaggggacctatgattgcccttgttattggctttttctgactggatgcttggagaagagccttcattcccttgaaaactttgctcaggacactggtggaggaagttgatgacatggacctaagagaaagtgttgagtacctgtattgcagctcacatatcatccttaagtccttagagtgagctgaggacccagcaagcacttgagagcgaagggcatggcatgttcacattcaaggcctgagagtaacagcaagtgagatctggaagggcagtgtgaagaggttggtaagagcaggagtgttgagggtgcctgtgagatatgacaagcccatagtacatggtaagcccataatccatgtggttttgaattggtcccactgtaatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacttgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgatgcaatgcactccaacgagcttgggtctatgatgattcccagtcaaacattccttggaaaagctgaacaaaatgagtgaaaactctctaccgccacagtcatcggaactgaggtccagcatcttgggtctcccaggtgctatgggcatcaggcacaggctgcccaaacactccattgttcttgacttcttcgggctctagccagactctccagagacaggtgtgtgcttggcctactctgccaaaaatccatggtgtaggacacagcaggtccttaagcactggtggcttgctccctttgctgtagtggagatgcttggcagatactcagtaggtagccttgctaggtccaaggagagggccccagccattgtggaaagtagactgtgaggcaaaagtagcagtggcagtggcaccaaatcttggcttttcacatgggaatatcaagcagtggaggcaggcttctcagaagcacttatatgaattttaaccctgttgcattgctttacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgtgggattggctaggaaatagagaaggagctaagccttggaggtgatggcaggcacctcacgggtcagtttgcaccacatttacacacttacctgtgtctgtagatggatgaaactttgatggactcactgggagcatgagacttgcagacctgtgtctcgatagatttgttgaaataatttttgtaggaatctcctctttggtaggtgctgttgctttggatgttgttgaagggatatccttggtatatttggaccttgttgtcagcctctttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataatttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacaaacacacacacacacacacacacacacacacacacactaacacagagagagggagagagggggggttcctttcagctgtgaaaatgaagcctgcttcccatgagctggaattctgaactctcagaggagtttgactttacctcatgcaaagacccagaagtaatgatcagagaagaactggagccatgattgaaggctcaaaagttgttggcttagatatccttggaggccaaattttgctggtggacttattcagagctgcctcctcctttttcgactgcataggcaaggggacctatgattgcccttgttattggctttttctgactgcatgcttggagaagagccttcattcccttgaaaactatgctcaggacactggtggaggaagttgatggcatggacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgagaagcccatagtacatggtaagcccataatccatgtggttttgcattagtcccactgtaatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacattgtaattgctgcttgaattctaggtgcccaggtcttggtggagcagggaacagctgccattgattatgtccaggcccttcgggacatggagcatgcctagggcctctggtttctcccatgtttggagtttcggcccattgttccctggcagtggattgtcagtgtccagcagtccattgctctccccaaagccagagcaatccagagtactggaaccacttgatgcaatgcactccaacgagcttggatctatgacgattcccagtcaaacattccttggaaaagctgaacaaaatgagtgaaaactctctaccgccactctcatcggaactgaggtccagccccttgggtctcccaggtgcgatgggcgtcaggcacaggctgcccaaacactccattgttcttgacttcttcgggctctagccagactctccagagacaggtgtgtgcttggcctactctgccaaaaatccatggtgtaggacacagcaggtccttaagcactggtggcttgctccctttgctttagtggagatgcttggcagatactcagtaggtagtcgtgctaggtccaaggagagggccccagccattgtggaaagtagactgtgaggcaaaagtagcagtggcagtggcaacaaatcttggcttttcacatgggaatatcgggcagtggactcagtcttctcagaagcacttatatgaattttaaccctgttgcattgctttacgtagtcaatagaatgcaggctgctggtagagtgtagcttgacctagtagcatgtaaactggactgtgtgactgttgtcagttcaggtggtgaacagaaggctctgtgtccctggagcttggaattttcccgggcaattggctaggaaatagagaaggagctaagccttggaggtgatggcaggcacctgacgggtcagtttgcaccacatttacacacttacctgtgtctgtagacggatgaaactttgatggactcgctgggagcatgagacttgcagacctgtgtctcaatagatttgttgaaataacttttgtaggaatctcctctttggtaggtgctgttgctttggatgttgttgaagggatatctttggaatatttggacattgttgtcagcctccttggcaaggtcaaagggaaagtctaggaacagttcttgcacccacagccttaggagaaccatcttggtgagggaccctctaaattagagactaaggtgtcatggcacctttcttttcgatgttttggcctaactcttctggaaagacacgttgctagtgtgcatgggaaggaggtttcaacagggcacatggtgttttgcaaatccaccttgagagccatgctcatgggaatcatcagggagaaaataagttcttggatgcagactgcatttgacacactaagataacttgagtcaagtcggatcctggcctgtgatagttctgcgcaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacagacacacacatacacacacacacacacacacacacacacacacatacacacacacacactaacacagagagagggagagagagggggggttcctttcagctgtaaaaatgaagcctgcttcccatgagctggaattctgaactctcagaggagtttgactttacctcatgcaaagacccagaagtaatgatcagagaaggactggagccatgattgaaggctcaaaagttgttggcttaggtattcttggaggccaaatgttgctggtggacttattcagagctgcctcctccttcttcgaatgcatagcaaggggacctatgattgcccttgttattggctttttctgactgcatgcttggagaagagccttcattcccttgaaaactatgctcaggacactggtggaggaagttgatggcatggacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtatgaagaggttggtaagagcaggagtgttgaaggtgcctgagatatgagaagcccatagtacatggtaagcccataatccatgtggttttgcattggtcccactgtaatcggggcatgttctttgtgttgtcttcacagggttgcattccctttccagtatggtccatgaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccattgctctccccaaagccagagcaatccagagtactggaaccacttgatgcaatgcactccaacgagcttggatctatgatgattcccagtcaaacattccttggaaaagctgaacaaaatgagtgaaaactctgtacagccactctcatcagaactgaggtccagcatcttgggtctcccaggtgctatgggcgtcaggaacaggctgcccaaacactccattgttcttgacttcttcgggctctagccagactctccagagacaggtgtgtgcttgacctactctgccaaaaatccatggcgtaaaacacagcaggtccttaagctctggtggcctgctccctttgctgtagtggagatgcttggcagatactcagtaggtagtcgtgctaggtccaaggagagggccccagccattgtggaaaatatactgtgaggcaaaaatagcagtggcagtggcaccaaattttggtttttcacatgggaatatcgggcagtggactcagtcttctcagaagcacttatatgaattttaaccctgttgcattgctttatgtagtcaatagaatgcaggctgctggtagagtgtagcttgacctagtagcatgtaaactggactgtgtgactgttgtcagttcaggtggtgaacagaaggctctgtgtccctggagcttggaattttcccgggcaattggctaggaaatagagaaggagctaagccttggaggtgatggcaggcacctgacgggtcagtttgcaccacatttacacacttacctgtgtctgtagacggatgaaactttgatggactcgctgggagcatgagacttgcagacctgtgtctcaatagatttgttgaaataacttttgtaggaatctcctctttggtaggtgctgttgctttggatgttgttgaagggatatctttggaatatttggaaattgttgtcagcctccttggcaaggtcaaagggaaagtctaggaacagttcctgcacccacagccttaggagaaccatcttggtgagggaccctctaaattagagactaaggtgtcatggcacctttcttttcgatgttttggcctaactcttctggaaagacacgttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggtgtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacccactaacacagagagagggagagagaggggggttcctttcagctgtgaaaatgaagcctgcttcccatgagctggaattctgaaccctcaaatgagtttgattttacctcatgcaaagacccagaaataatgatcagagaaggactgcagccatgattgaaggctcaaaagttgtttgcttagatatccatggaggcccaattttgctggtagacattttcagagctaccttctccttcttcgtcagcataggcaaggggacctatgattgcccttgttattggctttttcttaatggatgcttggagaagagccttcattcccttgaaaactttgctcaggacactggtggaggtagttgatggcatggacctaagagaatgtgttgagtaccattattgcagcccacatatcatccttaagtccttagattgaactgaggtggcagcaagcacttgagagcaaagggcatggcatgttcacatccaaggcctgagagtaacagcaagtgagatttggaagggcagtgtgaagaggttggtaagagcaggagtgttgaggggcctgtgagatatgacaagccatagtacatggtgagcccataatccatgtggttttgcattggttacactgcaatcggggcattttctctgtgcagtcttcacagggttgcattccctttccagtatggtccatggaaaacatgcagtggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctccctggtgctatgggcatcaggcacaggctgcccaaatactccattgttcttgactttttccggctctagccagactctccagagacaggtgtgtgcttggcctactctgtcaaaaatccatggcgtaggacacagcaggtccttaagctctggtggcttgctccctttgctgtagtggagatgcttggcagatactcagtaggtagccttgctaggtccaaggagagggccccagccattgtggaaagtagactgtgaggcaaaagtagcattggcaatggcaccaaatcttggtttttcacatgggaatatcaagcagtggactcaggcttctcagaagcacttatatgaattttaaccctgttgcattgctttatgtagtcaatagaatgcaggctgctggtagagtgtagcttgacccagtagcatgtaaacgggactgtgtgaatgttgtctgttcaggtggtgaacagaaggctctgtgtccctggcagcttggaagtttccctcgggattggctaggaaatagagaatgaactaacccttgcaggtgatagcatgcacctcacgggtcagtttgcaccaattttacactcttacctgtgtctgtagacggatgaaactttgatggactcgctgggagcatgagacttgcagacctgtgtctcgatagatttgttgaaataatttttgtaggaatctcctctttggtaggtgctgttgctttggatgttgttgaagggatatccttggtatatttggaccttgttgtcagccaccttggcaaggtcaaagggaaagtctaggaacagttcttgcacccacagccttaggagaaccatcttggtgagggaccctctaaattagaaaccaaggtgtcatgggaccattcttttcgatgttttgggctaactcttctggaaagacaagttgctcgtgtgcataggaaggaggtttcaacagggcacatcgtgttttgcaaatccacgttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaagttttcaccagaagagatcaaagcaggggtggatggccaaaagcaatctcatgagagaagtggaagtcttcacaatacacaaaatgagcactggacaggtggacagaaatagggactggctgccacagcaaggaatgtctcagggtaaaagacacacacaaacacacacacacacacacacacactaacacagagagagggagagagaggggggttcctttcagctgtgaaaatgaagcctgcttcccatgagctggatttctgaactctcaaaggagtttgattttacctcatgcaaagacccagaagtaatgatcagagaagaactgtagccatgattgaaggctcaaaagttgttgacttagatatccttggaggcccaattttgcgggtggacttattcagagctgactcctccttctttgtcagcataggcaaggggacctatgattgcccttgttattggctttttctgtctggatgcttggagaagagccttcattcccttgaaaactttgctcaggacaatggtggaggaagttgatggcatggacctaagagaaagtgttgagtacctgtattgcagctcacatatcatccttaagtccttagagtgagctgaggacccaggaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccatagtacatagtgagcccataatccatgtggttttgcattggtcccactgtaatcggggcatgttctctgtgctgtcttcacagggttgcattccctttccagtatggtccatggaaaacatgcagaggaaatggccccacagcattggctgagtgtttatgtcatccaaccgagtctccatcgaactgttgtggtgttgctgacttgccctaggtcacttgagttaaatggtaaggaacatgggaatggctgcatgaattctaggtgcccaggtcttggtggagaagggaacggctgccattgattatgtccaggcccttcgggacatggagcatgcatagggcctctggtttctcccatgtttggagtttcggcccattgttccctggcagtggattgtcagtgtccagcagtccattgctctccccaaagccagagcactccagagtactggaaccacgtgatgcaatgcactccaacgagcttggatctatgacgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactctattcttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcgtgctaggtccaaggagagcaccccagccattgtggaaagtacactgtgaggcaaaagtagcagtggcagtggcaccaaatcttggtttttcacatgggaatatcgggcagtggactcaggcttctcagaagtacttatatgaattttaaccctgttgcattgctttacgtagtcaatagaatgcaggctgctgatagagtgtagcttgacccagtagcatgtaaacgggactgtgtgactgttgtcggttcagttggtgaacagaaggctctgtgtccccggcagcctggaagtttcccgggtgattggctaggaaatagagaaggagctaagccttggagttgatggcaggcacctcacgggtcagtttgcaccacatttacacacttacctgtgtctgtagacggatgaaactttgatggactcgctgggagcatgagacttgcagacctgtgtctcgatagatttgttgaaataatttttgtaggaatctcctctttggtaggtgctgttgctttggatgttgttgaagggatatccttggtatatttggaccttgttgtcagccaccttggcaaggtcaaagggaaagtctaggaacagttcttgcacccacagccttaggagaaccatcttggtgagggaccctctaaattagaaaccaaggtgtcatgggaccattcttttcgatgttttgggctaactcttctggaaagacaagttgctcgtgtgcataggaaggaggtttcaacagggcacatcgtgttttgcaaatccacgttgagagccatgctcatgggaatcatcagggagaaaataagttcttggatgcagactgcatatgacacactaagataacttgagtcaagtcggatcctggcctgtgatagttctgcacaatgggattttcattagtgtgagaagctgagcagtatagtctgagaagttttcaccagaagagatcaaagcaggggtggatggccaaaagcaatctcatgagagaagtggaagtcttcacaatacacaaaatgagcactggacaggtggacagaaatagggactggctgccacagcaaggaatgtctcagggtaaaagacacacacaaacacacacacacacacacacacacactaacacagagagagggagagagaggggggttcctttcagctgtgaaaatgaagcctgcttcccatgagctggatttctgaactctcaaaggagtttgattttacctcatgcaaagacccagaagtaatgatcagagaagaactgtagccatgattgaaggctcaaaagttgttgacttagatatccttggaggcccaattttgcgggtggacttattcagagctgactcctccttctttgtcagcataggcaaggggacctatgattgcccttgttattggctttttctgtctggatgcttggagaagagccttcattcccttgaaaactttgctcaggacaatggtggaggaagttgatggcatggacctaagagaaagtgttgagtacctgtattgcagctcacatatcatccttaagtccttagagtgagctgaggacccaggaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccatagtacatagtgagcccataatccatgtggttttgcattggtcccactgtaatcggggcatgttctctgtgctgtcttcacagggttgcattccctttccagtatggtccatggaaaacatgcagaggaaatggccccacagcattggctgagtgtttatgtcatccaaccgagtctccatcgaactgttgtggtgttgctgacttgccctaggtcacttgagttaaatggtaaggaacatgggaatggctgcatgaattctaggtgcccaggtcttggtggagaagggaacggctgccattgattatgtccaggcccttcgggacatggagcatgcctagggcctctggtttctcccatgtttggagtttcggcccattgttccctggcagtggattgtcagtgtccagcagtccattgctctccccaaagccagagcactccagagtactggaaccacgtgatgcaatgcactccaacgagcttggatctatgacgattcccagtcaaacattccttggaaaagctgaacaaaatgagtgaaaactctgtaccgccactctcatcggaactgaggtccagcatcttgggtctcccaagtgctatgggcgtcaggcacaggctgcccaaccactctattcttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcgtgctaggtccaaggagagcaccccagccattgtggaaagtacactgtgaggcaaaagtagcagtggcagtggcaccaaatcttggtttttcacatgggaatatcgggcagtggactcaggcttctcagaagtacttatatgaattttaaccctgttgcattgctttacgtagtcaatagaatgcaggctgctgatagagtgtagcttgacccagtagcatgtaaacgggactgtgtgactgttgtcggttcagttggtgaacagaaggctctgtgtccccggcagcctggaagtttcccgggtgattggctaggaaatagagaaggagctaagccttggagttgatggcaggcacctcacgggtcagtttgcaccacatttacacacttacctgtgtctgtagacggatgaaactttgatggactcgctgggagcatgagacttgcagacctgtgtctcaatagatttgttgaaataacttttgtaggaatctcctctttggtaggtgctgttgctttggatgttgttgaagggatatctttggaatatttggacattgttgtcatcctccttggcaaggtcaaagggaaagtgtaggaacagttattgcacccacagccttaggagaaccatcttggtgcgggaccgtctaaattagagaccaaagtgtcatgggaccttccttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtacagtctgagaacttttcaccagaagagttcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacacactaacacagagagagggagagagaggggggttcctttcagctgtgaaaatgaagcctgcttcccatgagctggaattctgaaccctcaaatgagtttgattttacctcatgcaaagacccagaaataatgatcagagaagaactggagccatgattgaaagctcaaaagttgttggcttagatatccttggaggcccaattttgcgggtggacttattcagagctgactcctccttcttcgtcagcataggcaaggggacctatgattgcccttgttattggctttttctgactggatgcttggagaagagccttcattcccttgaaaactttgctcaggacactggtggaggaagttgatggcatggacctaagagaaagtgttgagtacctgtattgcagctcacatatcatccttaagtccttagagtgatctgaggacccagcaagcacttgagagcaaagggcatggcatgttcacatccaaggcctgagagtaacagcaagtgagatctggaagggcagtgtgaagaggttggtaagagcaggaatgttgagggtgcctgtgagatatgacaagcccatagtacatggtgagcctataatccatgtggttttgcattggtcccactgtaatcggggcatgttctctgtgctgtcttcacagggttggattccctttccagtatggtccatggaaaacatgcagaggaaatggccccacagcattggctgagtgtttatgtcatccaaccgagtctccatcgaactgttgtggtgttgctgacttgccctaggtcacttgagttaaatggtaaggaacatgggaattgctgcatgaattctaggtgcccaggtcttggtggagcagggaaaggctgccattgattatgtccaggcacttcgggacatggagcatgcctagggcctctggtttctcccatgtttggagtttcggcccattgttccctggcagtggattgtcagtgtccagcagtccattgctctccccaaagccagagcactccagagtactggaaccacgtgatgcaatgcactccaacgagcttggatctatgacgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactctattcttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcgtgctaggtccaaggagagcaccccagccattgtggaaagtacactgtgaggcaaaagtagcagtggcagtggcaccaaatcttggtttttcacatgggaatatcgggcagtggactcaggcttctcagaagtacttatatgaattttaaccctgttgcattgctttacgtagtcaatagaatgcaggctgctgatagagtgtagcttgacccagtagcatgtaaacgggactgtgtgactgttgtcggttcagttggtgaacagaaggctctgtgtccccggcagcctggaagtttcccgggtgattggctaggaaatagagaaggagctaagccttggagttgatggcaggcacctcacgggtcagtttgcaccacatttacacacttacctgtgtctgtagacggatgaaactttgatggactcgctgggagcatgagacttgcagacctgtgtctcaatagatttgttgaaataacttttgtaggaatctcctctttggtaggtgctgttgctttggatgttgttgaagggatatctttggaatatttggacattgttgtcatcctccttggcaaggtcaaagggaaagtgtaggaacagttattgcacccacagccttaggagaaccatcttggtgcgggaccgtctaaattagagacgaaagtgtcatgggaccttccttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtacagtctgagaacttttcaccagaagagttcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacactaacacagagagagggagagagaggggggttcctttcagctgtgaaaatgaagcctgcttcccatgagctggaattctgaaccctcaaatgagtttgattttacctcatgcaaagacccagaaataatgatcagagaagaactggagccatgattgaaagctcaaaagttgttggcttagatatccttggaggcccaattttgcgggtggacttattcagagctgactcctccttcttcgtcagcataggcaaggggacctatgattgcccttgttattggctttttctgactggatgcttggagaagagccttcattcccttgaaaactttgctcaggacactggtggaggaagttgatggcatggacctaagagaaagtgttgagtacctgtattgcagctcacatatcatccttaagtccttagagtgatctgaggacccagcaagcacttgagagcaaagggcatggcatgttcacatccaaggcctgagagtaacagcaagtgagatctggaagggcagtgtgaagaggttggtaagagcaggaatgttgagggtgcctgtgagatatgacaagcccatagtacatggtgagcctataatccatgtggttttgcattggtcccactgtaatcggggcatgttctctgtgctgtcttcacagggttggattccctttccagtatggtccatggaaaacatgcagaggaaatggccccacagcattggctgagtgtttatgtcatccaaccgagtctccatcgaactgttgtggtgttgctgacttgccctaggtcacctgagttaaatggtaaggaacatgggaattgctgcatgaattctaggtgcccaggtcttggtggagcagggaaaggctgccattgattatgtccaggcacttcgggacatggagcatgcctagggcctctggtttctcccatgtttggagtttcggcccattgttacctggcagtggattgtcagtgtccagcagtccattgctctccccaaagccagagtactccagagtactggaaccacttgatgcaatgcacttcaacgtgcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactctattgttcttgacttcttcgggctctagccagactctccagagaaaggtgtgtgcttggcctactctgccaaaaatccatggcgtaggacacagcaggttcttaagctctggtggcttgctccctttgctgtagtggagatgtttggcatatactcagtaggtagttgtgctgggtctaaggagagggcccagccattgtggaaagtagactgtgaggcaaaagtagcagaggcagtggcaccaaatcttggtttttcacatgggaatatctggcagtggactcaggcttgtcagaagcacttgtatgaattttaaccctgttgcattgctttaggtagtcaatagaatgcaggctgctggttagaatgtagcttgacccagtagcgtgtaaacgggactatgtgactgttgtctgttcaggtggtgaacagaaggctctgtgtccctggcagcttgaaagtttccagggcgattggcttggaaatagagatggagctaagccttggaggtgatggcaagcacctcacgggtcagtttgcaccacatttacacacttacctgtgtctgtagatggatgaaactttgatggactcgctgagagcatgagacttgcagacctgtgtctccataggattgttgaaataacttttgtaggaatctactctttggtaggtgctgttgctttggattttgttgaagggatgtccttggaatatttggacattgttgtcagcctccttgtctaggtcaaagggaaagtctaggaacagttcttgcacccacagccttaggagaaccatcttggtgagggaccctctaatttagagaccaaggtgtcatgggacctttcttttcaattttttggcctaactgttctgggaagacaaattgatagtgtgcataggaaggaggtttcaacagggcatatcgtgttttgcaaatccaccttgagagccatgctcatggtcatcatcagggagaaaataagttcttggatgcagactgcatttgacacactaagataacttgagtcaagtttgatccaggcctgtgatagttctgcacaatgggattttcattagtgtgataagctgagcagtatagtctgagaagttttgaccagaagagatcaaagcaggggtggatggccaaaagcaatctcatgagagaggtggaagtcttcacaacagacaaaatgagaactgggcctgtggacagaaatagggattggctgccacaccatggaatgtctcagggtaaaagacacacacacacaaacacacacatacacacacacaacacacactaacacagagagagggagagagaggggggggattcttttcatctgttaaaatgaagcctgcttcccatgagctggaattctgaaccctcagaggagtttgattttgcctcatgcaaagacccagatgtaatgatcagagaaggactggagccatgattgaaggctcaaaagttgtttgcttagatatccatggaggtccaattttgctggtggacttattcagagctgcctccccctgctttgtcagcataggcaatgggacctatgattgcccttgttattggctttttctgactggatgcttggagaagagccttcatacccttgaaaactttgctcggtacactggtggaggaagttgatggcatggacctaagagaaagtgttgagtacgtgtattgcagctcacatatcatccttaagtccttagagagagctgaggacccagcaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtccaactgtaatcggggcatgttctttgtgttgtcttcacagggttgcattccctttccagtatggtccatggacaacatgcagaggaaatggccccacagcattggctgagtgtttatgtcgtccaaccgagtctccatcgaactgttgtggtgttgctgacttgccctaggtcacctgagttaaaaggtaaggaacatgggaattgctgcatgaattctaggtgcccaggtcttggtgagcagggaacggctgccattcatatgtccaggcccttcgggacatggagcatgcctagggcctctggtttctcccaggtttggagcttcggcccattgttccctggcagtggattggcagtgtccagcagtccattgctctccccaaagccagagcactccagagtactggaaccactttatgcaatgcactccaacgtgctcggatctatgatgattcccagtcaaacattccttggaaaagctgaacaaaatgagtgaaaactgtaccgccactctcatcggaactgaggtccagcatcatgggtctcccaggtgctatgggtgtcaggcacaggctgcccaaacactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcttgctaggtccaaggagagggccccagccattgtggaaagtagactgtgaggcaaaagtagcagtggcagtggcaccaaatcatggttttcacatgtgtatatctggcagtggactcaggcttctcagaagcacttatatgaattttaaccctgttgcattgctttacgtagtcaatagaatgcaggctgctggtagagtgtagcttgacccagtagcatgtaaacgggactgtgtgactgttgtctgttcaggtggtgaacagaaggctctatgtccctggcagcttggaagtttctcgggtgattggcttggaaatagagaaggagctaagccttggaggtgatggcaggcacctcacgggtcagtttgcaccacacttacacacttacctatgtctgtagacagataaaactttgatggacttgctgggagcatgagacttgcagacctgtgtctcgatagatttgttgaaataactttgtaggaatctccccttttgtaggtgctgttgcttttgatgttgttgaagggatatccttggtatatttggacattgttgtcagcctccttggcaagggcaaagggaaagtctaggaacagttcttgcacccacagccttaggagaaccatcttggtgagggaccctctaaattagagaccaaggtgtcatgggacctatcttttcaatgttttggcctaactcctctggaaagacaagttgctagtgtgcatgggaaggaggtttcaacagggcacatggtgttttgcaaatccaccttgagagccatgctcatgggaatcatcagggagaaaataagttcttggatgcagactgcatttgacacactaagataacttgagtcaagttggatcctggcctgtgatagttctgcacaatgggattttcattagtgtgagaagctgagcagagtagtctgagaacttttcaccagaagagatcaaagcaggggtggatggccaaaagcaatcttatgagagaggttgaagtcttcacaacagacaaaatgagcactggacaggtggacagaaatagggactggctgccaccgcaaggaatgtctcagggtaaaagacacacacacacatacacaaacacacacacacacacacacactctaacacagagagagggagagagtggggggctcctttcagctgtgaaaatgaagcctgcttcccatgagctggaattctgaactctcagaggagtttgattttacctcaagcaaagacccagaagtaatgatcagagaagtactggagccatgattgaaggctcaaaatttgttggcttagatatccttggaggcccaattttgctggtggacttattcagagctgcctcctccttcttcgtcagcataggcaaggggacctatgattgcccttgttattggctttttctgactggatgcttggagaagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagcaaagagcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctctgtgctgtcttcacagggtttcattccctttccagtatggttcatggaaaacgtgcagaggaaattgccccacagcattggctgagtgtttatgtcgtccaaccgagtctccatccaactgttgtggtgttgctgacttgccctaggtcacctgagttaaaaggtaaggaacatgggaattgctgcatgaattctaggtgcccaggtcttggtggagcagggaacggctgccattgattatgtccaggcccttcgggacatggagcatgcctagggcctctggtttctccaaggtttggagcttcggcccattgttccctggcagtggattggcagtgtccagcagtccattgctctccccaaagccagagcactccagagtactggaaccacttgatgcaatgcactccaacgtgctcggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctctagagacaggtgtgtgcttggcctactctgccaaaaatccatgtcgtaggacacagcaggttttttaagctctggtggcttgctcccttggttgtagtggagatgcttggcagatactcagtaggtagttgtactaggtccaaggagagggctccagccattgtggaaagtagactgtgaggcaaaagtagcagtggcagtgacaccaaatcttggcttttcacatgggaatatctggcagtggactcaggcttctcagaagcacttatatgaattttaaccctgttgcattgctttaagtagtcaatagaatgcaggctgctggtagagtgtagcttgacccagtagcatgtaaacgagactgtgtgactgttttcagttcaggtggtgaacagaaggctctgtgtccctggcagcttggaagtttccctggcgattggcttggaaatagcggaagagctaagccttggagtgatggcagtctcctcatgggtcagtttgcaccacatttacacacttacctgtgtctgtagatggatgaaactttgatggactcgctgggagcatgagaattgcagacctgtgtctcgatagatttgttgaaataatttttgtaggaatctcccctttggtaggtgctgttgctttggatgttgttgaagggatatccttggcatatttggacattgttgtcagcctccttggcaagggcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataaaaaggaggtttcaacagggcacatcgtgttttgcaaatccaccttgagagccatgctcatgggaatcatcagggagaaaatatgttcttggatgcagactgcatttgacactctaagataacttgaggcaagttagatcctgccctgtggtagttctgcacaatgggattttcattagtgtaagaggctgagcagtatagtctgagaagttttcaccagaagagatcagagcaggggtggatggccaaaagcaatcttataagagagttggaagtcttcacaacagacaaaatgagcactggacaggtggacagaaatagggactggctgccacagcaaggaatgtctcagggtaaaagacacacacacacacacacacacacacacacacacacacacacacacacacacacacactaacacagagagagggagagacaggggggttcctttcagctgtgaaaatgaagcctgcttcccatgagctggaattctgaaccctcagtggagtttgattttacctcatgcaaagacccagatgtaatgatcagagaaggactggagccatgattgaaggttcaaaagttgttgccttagatatccatggaggcccaattttgctggtggacttattcagagctgcctcctccttctttgtcagcataggcaaggggacctatgattgcccttgttattggctttttctgactggatgcttggagaagagccttcatttccttgaaaactttgctcaggacactggtggaggaagttgatggcatggacctaagagaaagtgttgagtacctgtattgcagctcacatatcatccttaagtccttagagtgagcagaggacccagcaagcacttgagagcaaagagtatggcatgttcacatccaaggcctgagagtaacagcaagtgagatctggaagggcagtgtgaagaagttggtaagagcaggagtgttgagggtgcctgtgagatatgacaagcccatagtacatggtaagcccataatccatgtggttttgcattggtcccactgtaatcggggcatgttctctgtgttgtcttcacagtgtttcattccctttccagtatggttcatggaaaacatgcagaggaaattgccccacagcattggctgagtgtttatgtcgtccaaccgagtctccatcgaactgttgtggtgttgctgacttgccctaggtcacctgagttaaaaggtaaggaacatgagaattgctgcatgaattataggtgcccaggtcttggtggagcagggaaaggctgccattgattatgtccaggcccttgggacatggagcatgcctagggcctctggtttctcccaggtttggagcttcggcccattgttccctggcagtggattggcagtgtccagcagtccattgctctccccaaatccagagcactccagagtactggaaccacttgatgcaatgcactccaacgtgctcggatctatgatgattcccagtcaaacattccttggaaaagctgaacaaaatgagtgaaaactctgtaccaccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatgtcgtaggacacagcaggttttttaagctctggtggcttgctccctttgttgtagtggagatgcttggcagatactcagtaggtagttgtactaggtccaaggagagggctccagccattgtggaaagtagactgtgaggcaaaagtagcagtggcagtgacaccaaatcttggcttttcacatgggaatatctggcagtggactcaggcttctcagaagcccttatatgaattttaaccctgttgcattgctttacttagtcaatagaatgcaggctgctggtagagtgtagcttgacccagtagcatgtaaacgggactgtgtgactgttgtcggttcaggtggtgaacagaaggctctgtgtccctggcagtttggaagtttcccgggcgattgccttggaaatagcggaggagctaagccttggaggtgatggcagtcacctcacgggtcagtttgcaccacatttacaaacttacctgtgtctgtagacagatgaaactttgatggactcgctgggagcatgagacttgcagacctgtgtctcgatagatttgttgaaataatttttgtaggaatctcccctttggtaggtgctgttgctttggatgttgttgaagggatatccttggtatatttggacattgttgtcagcctccttggcaaggtcaaacggaaagtctgggaacagttctggcacccacagccttaggagaaccatcttggtgagggaccctctaaattagagaccaaggtgtcatgggacctttcttttcgatgttttggcctaactcttctggaaagacaagttgctagtgtacataggaaggaggtttcaacagggcacatcgtgttttgcaaatccaccttaagagccatgctcatgggaatcatcagaaagaaaatatgttcttggatgcagactgcatttgacactctaagataacttgaagcaagttagatcctgccctgtggtagttctgcacaatgggattttcattagtgtgagaagctgagcagtatagtctgagaagttttcaccagaagagatcagatcaggggtggatggccaaaagcaatcttataagagagctggaagtcttcacaacagacaaaatgagcactggacaggtggacagaaatagggactggctgccacagcaaggaatgtctcagggtaaaagacacacacacacacacacactaaaacagagatagggagagagtgggggttcttttcagctgtgaaaatgaagcctgcttcccatgagctagaattctgaaccctcagaggagtttgattttacctcatgcaaagacccagaagtaatgatcagagaaggactggagccatgattgaagtgtcaaaaattgtttgcttagatatccaaggaggcccaattttgctggtggacttattcagagctgcctccccattcttcttcagcataggcaaggggacatatgattgcccttgttattggctttttctgacaggatgcttggagtagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggtccgagagtaacagcaagtgagatctggaagggcagtgtgaagaggttggtaagagcaggagtgttgagggtgcctgtgagatatgacgagcccatagtacatggtaagcccataatccatgtggttttgcattggtcccactgtaatcggggcatgttctctgtgctgtcttcacagggttgcattccctttccagtatggtccatggaaaacatgcagaggaaatggccccacagcattgtctgagtgtttatgttgtccaaccgagtctccatcgaactgttgtggtgttgctgatttgccctaggtcacctgagttaaaaggtaaggaacatgggaaatgctgcatgaattctaggtgcccaggtcttggtggagcagtgaacggctgccattgatatgtccaggcccttcgggacatggagcatgcctagggcctctggtttctcccacgtttggagattcggcccattgttccctggcagtggattggcagtgtccagcagtccattgtctccccaaagccagagcactccagagtactggaaccacttgatgcaatgcactccaatgtgcttggatctatgatgatacccagtcaaacattccttggaaaagctgaacaaaatgagtgaaaactctttaccgccactctcttcggaactgaggtccaccatcttgggtctcccaggtgctatgggcatcaggcacaggctgccgaaccactccattgttcttgacttcttcgggatctagccagactctccagagacaggtgtgtgcttggcctactctgccaaaaatccatggcgtaggacacagcaggtccttaagctctggtggcttgctccctttgctgtagtggagatgcttggcagatactcagtaggtagtcttgctaggtccaaggagagggccccagccattgtggaaagtagactgtgaggcaaaagtagcagtggcagtggcactaaattttggcttttcacatgggaacatcaagcagtggactcaggcttctcagaagcacttatatgaattttaaccctgttgcatttctttatgtagtcaatagaatgcaggctgctggtatagtgtagcttgacccagtaacttgtaaagggaactgtgtgactgttgtctgttcaggtggtgaacagaaggctctgtgtccctgggagctttgaagtttcccggggaattggctaggaaatagagaaggagctaagccttggaggtgatggcaggcacctcacaggtcagtttgcaccacatttacacacttacctgtgtctgtagacggatgaaactttgatggactcgctgggagcatgagacttgcagacctgtgtctcgatagatttgttgaaatgacttttgtaggaatctcctctttggtaggtgctgttgctttggatgttgttgaagggatatccttggtatatttggaaattgttgtcagcctccttgtctaggtcaaagggaaagtctaggaacagttcttgcacccacagccttaggagaaccatcttggtgagggaccctctaatttagagaccaaggtttcatgggacctttcttttcaattttttggcctaactgttctggaaagacaagttgatagtgggcataggaaggaggtttcaacagggcacatcatgttttgcaaatccaccttgagagccatgctcatggggatcatcagggagaaaataagttcttggatgcagactgcatttgacacactaacataacttgagtcaagtttgatcctggcctgttatagttctgcacaatgggattttcattagtgtgagaagctgagcagtacagtctgagaacttttgaccagaagagatcaaagcaggggtggatggccaaaagcaatctcatgatagaggtggaagtcttcacaacagacaaaatgagcactggacaggtggacagaaatagggactggctgccacagcaaggaatgtctcagggtaaaagacacacacacacacacacacacacacaaacacacacacacacacacacacacacacactaacacagagagagggagagaaagggggggttcctttcagctgtgaaaatgaagcctgcttcccatgagctggaattctgaaccctcagaggagtttgattttaccttatgctaagacccagaagtaatgatcagagaaggactggagccatgattgaaggctcaaaagttgttggcttagatatccatggaggctcaattttgctggtggacttattcagagcttcctcctccttcttcttcagcataggcaaggggacctatgattgcccttgttattggctttttctgactggatgcttggagaagagccttcattcccttgaaaactttgctaaggacactggtggaggaagttgatggcatggacctaagagaatgtgttgagtacctgtattgcagctcacatatcatccttaagtccttagagtgagctgaggacccagcaagcacttgagacaaagggcatggcatgttcacatccaaggcctgagagaaacagcaagtgagatctggaagggcagtgtgaagaggttggtaagagcagttgtgttgagggtgcctgtgagatatgacaagcccatagtacatggtaagcccataatccatgtggttttgcattggtcccactgtaatcggggcattttttctgtgctgtctttacagggttgcattccctttccagtatgttccatggtaaacatgcagaggaaatggccccacagcattggatgagtgtttatgtcgtccaaccgagtctccatcgaactgttgtggtgttgctgacttgccctaggtcacctgagttaaaaggtaaggaacatgggaattgctgcatgaattctaggtgctcaggtcttggtggagcagggaacggctgccattgaatgtgtccaggcccttcgggacatggagcatgcctagggcctctggtttctcccatgtttggagcttcggcccattgttccctggcagtggattgtcagtgtccagcagtccattgctctacccaaagccagaacactccagagtactggaaccacttgatgcaatgcactccaacgtgcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctaccctgccaaaaatccatggcataggacacagcaggtccttaagctatggtggcttgctccctttgctgtagtggagatgcttggcagatactcagtaggtagttatgctaggtccaaggagagggccccagacattgtggaaagtagagtgtgaggcaaaattgcagtggcagtggcaccaaatcttggcttttcacatgggaatatcaagcagtggactcaggcttctcagaagcacttatatgaattttaaccctgttgcattgctttatggagttaatagaatgcaggctgctggtagagtgtagcttgacccagtagcatgtaaacgggactgtgtgactgttgtctgttcaggtggtgaacagaaggctctgtgtccctggcagcttggaagtttcctgggtgattggcttggaaataagaaggagctaagccttggaggtgatggcaggcacctcacgggtcagtttgcaccacatttacacacttacctgtgtctgtagattgatgaaactttgatggactcgctggaagcatgagagttgcagacctgtgtctcgatagatttgttgaaataacttttgtaggaatctcccctttggtaggtgctgttgctttggatgttgttgaagggatatccaaggtatatttggatattgatgtcagcctccttgtcaaggtcaaagggaaagtctaggaacagttcttgcacccacagccttaggagaaccatcttggtgagggaccctctaaattagagaccaaggtgtcatgggacctttcttttcgatgttttggccttactcctctggaaagacaagttgcaagtgtacataggaaggaggtttcaacaggggacatcgtgttttgcaaatccaccttgagagccatgctcatgggaatcatcagggagaaaataagttcttggatgcagacttcatttgacactctaagataacttgagtcaagttggatcctggcctgtgatagttctgcacaatgggattttcattagtgtgagaagctgagcagtacagtctgagaagttttcaccagaagagatcaaagcaggggtggatggccaaaagcaatctcatgagagaggtgaaagtcttcacaacagacaaaatgagcactggacaggtggacagaaataggaactggctaccacagcaaggaatgtctcagtgtaaaagcaacacacacacacacacacacacatacacacgcacacacacacacacacacacacacacacacacactaacacagagagagggaccgagagggggtttcctttcaactgtgaaaatgaagcctgcttcccatgagctggaattctgaactctcagaggagtttgattttacctcatgcaaagacccggaattaatgatcagagaaggactggagccatgattgaaggctcaaaagttgttggcttagatatctttggaggcccaattttgctggtggacttattcagagctgcctcctccttcttcatcagcatagccaagaggacctatgattgcgcttgttattggatttttctgactggatgcttggagaagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggcccgagagtaacagcaagtgagatctggaagggcagtgtgaaggggttggtaagagcaggagtgtagagggtgccggtgagatatgacaagcccatagtacatggtaagcccataatccatgcggattttcattggtcccactgtaatcggggcatgatctctgtgctgtcttcacagggttgcattccctttccagtatggtccatggaaaacatgcagaggaaatggccccacagcattggctgagtgtttatgtcgtccaaccgagtctccatcgaactgttgtggtgttgctgacttgccctaggtcacctgagttaaaaggtaaggaacatgggaattgctgcatgaattctaggtgctcaggtcttggtggagcagggaacggctgccattgaatgtgtccaggcccttcgggacatggagcatgcctagggcctctggtttctcccatgtttggagcttcggcccattgttccctggcagtggattgtcagtctccagcagtccattgctctacccaaagccagaacactccagagtactggaaccacttgatgcaatgcactccaacgtgcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctaccctgccaaaaatccatggcataggacacagcaggtccttaagctatggtggcttgctccctttgctgtagtggagatgcttggcagatactcagtaggtagttatgctaggtccaaggagagggccccagacattgtggaaagtagagtgtgaggcaaaattgcagtggcagtggcaccaaatcttggcttttcacatgggaatatcaagcagtggactcaggcttctcagaagcacttatatgaattttaaccctgttgcattgctttatggagttaatagaatgcaggctgctggtagagtgtagcttgacccagtagcatgtaaacgggactgtgtgactgttgtctgttcaggtggtgaacagaaggctctgtgtccctggcagcttggaagtttcctgggtgattggcttggaaataagaaggagctaagccttggaggtgatggcaggcacctcacgggtcagtttgcaccacatttacacacttacctgtgtctgtagattgatgaaactttgatggactcgctggaagcatgagagttgcagacctgtgtctcgatagatttgttgaaataacttttgtaggaatctcccctttggtaggtgctgttgctttggatgttgttgaagggatatccaaggtatatttggatattgatgtcagcctccttgtcaaggtcaaagggaaagtctaggaacagttcttgcacccacagccttaggagaaccatcttggtgagggaccctctaaattagagaccaaggtgtcatgggacctttcttttcgatgttttggccttactcctctggaaagacaagttgcaagtgtacataggaaggaggtttcaacagggcacatcgtgttttgcaaatccaccttgagagccatgctcatgggaatcatcagggagaaaataagttcttggatgcagacttcatttgacactctaagataacttgagtcaagttggatcctggcctgtgatagttctgcacaatgggattttcattagtgtgagaagctgagcagtacagtctgagaagttttcaccagaagagatcaaagcaggggtggatggccaaaagcaatctcatgagagaggtgaaagtcttcacaacagacaaaatgagcactggacaggtggacagaaatagggactggctaccacagcaaggaatgtctcagtgtaaaagcaacacacacacacacacacacacatacacacgcacacacacacacacacacacacacacacacacacacacacacacacacacacacactaacacagagagagggaccgagagggggtttcctttcaactgtgaaaatgaagcctgcttcccatgagctggaattctgaactctcagaggagtttgattttacctcatgcaaagacccggaattaatgatcagagaaggactggagccatgattgaaggctcaaaagttgttggcttagatatctttggagacccaattttgctggtggacttattcagagctgcctcctccttcttcatcagcatagccaagaggacctatgattgtgcttgttattggatttttctgactggatgcttggagaagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggcccgagagtaacagcaagtgagatctggaagggcagtgtgaaggggttggtaagagcaggagtgtagagggtgccggtgagatatgacaagcccatagtacatggtaagcccataatccatgcggattttcattggtcccactgtaatcggggcatgatctctgtgctgtcttcacagggttgcattccctttccagtatggtccatggaaaacatgcagaggaaatggccccacagcattggctgagtgtttatgtcgtccaaccgagtctccatcgaactgttgtggtgttgctgacttgccctaggtcacctgagttaaaaggtaaggaacatgggaattgctgcatgaattctaggtgctcaggtcttggtggagcagggaacggctgccattgaatgtgtccaggcccttcgggacatggagcatgcctagggcctctggtttctcccatgtttggagcttcggcccattgttccctggcagtggattgtcagtctccagcagtccattgctctacccaaagccagaacactccagagtactggaaccacttgatgcaatgcactccaacgtgcttggatctatgatgattcccagtcaaacattccttggaaaagctgaacaaaatgagagaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctaccctgccaaaaatccatggcataggacacagcaggtccttaagctatggtggcttgctccctttgctgtagtggagatgcttggcagatactcattaggtagttatgctaggtccaaggagagggccccagacattgtggaaagtagagtgtgaggcaaaattgcagtggcagtggcaccaaatcttggcttttcacatgggaatatcaagcagtggactcaggcttctcagaagcacttatataaattttaaccctgttgcattgctttatggagttaatagaatgcaggctgctggtagagtgtagcttgacccagtagcatgtaaacgggactgtgtgactgttgtctgttcaggtggtgaacagaaggctctgtgtccctggcagcttggaagtttcctgggtgattggcttggaaataagaaggagctaagccttggaggtgatggcaggcacctcacgggtcagtttgcaccacatttacacacttacctgtgtctgtagattgatgaaactttgatggactcgctggaagcatgagagttgcagacctgtgtctcgatagatttgttgaaataacttttgtaggaatctcccctttggtaggtgctgttgctttggatgttgttgaagggatatccaaggtatatttggatattgatgtcagcctccttgtcaaggtcaaagggaaagtctaggaacagttcttgcacccacagccttaggagaaccatcttggtgagggaccctctaaattagagaccaaggtgtcatgagacctttcttttcgatgttttggccttactcctctggaaagacaagttgaaagtgtacataggaaggaggtttcaacagggcacatcgtgttttgcaaatccaccttgagagccatgctcatgggaatcatcagggagaaaataagttcttggatgcagacttcatttgacactctaagataacttgagtcaagttggatcctggcctgtgatagttctgcacaatgggattttcattagtgtgagaagctgagcagtacagtctgagaagttttcaccagaagagatcaaagcaggggtggatggccaaaagcaatctcatgagagaggtgaaagtcttcacaacagacaaaatgagcactggacaggtggacagaaatagggactggctaccacagcaaggaatgtctcagtgtaaaagcaacacacacacacacacacacacatacacacgcacacacacacacacacacacacacacacacacacacacacacacacactaacacagagagagggaccgagagggggtttcctttcaactgtgaaaatgaagcctgcttcccatgagctggaattctgaactctcagaggagtttgattttacctcatgcaaagacccggaattaatgatcagagaaggactggagccatgattgaaggctcaaaagttgttggcttagatatctttggagacccaattttgctggtggacttattcagagctgcctcctccttcttcatcagcatagccaagaggacctatgattgcgcttgttattggatttttctgactggatgcttggagaagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggcccgagagtaacagcaagtgagatctggaagggcagtgtgaaggggttggtaagagcaggagtgtagagggtgcctgtgagatatgacaagcccatagtacatggtaagcccataatccatgcggattttcattggtcccactgtaatcggggcatgatctctgtgctgtcttcacagggttgcattccctttccagtatggtccatggaaaacatgcagaggaaatggccccacagcattggctgagtgtttatgtcgtccaaccgagtctccatcgaactgttgtggtgttgctgacttgccctaggtcacctgagttaaaaggtaaggaacatgggaattgctgcatgaattctaggtgctcaggtcttggtggagcagggaacggctgccattgaatgtgtccaggcccttcgggacatggagcatgcctagggcctctggtttctcccatgtttggagcttcggcccattgttccctggcagtggattgtcagtctccagcagtccattgctctacccaaagccagaacactccagagtactggaaccacttgatgcaatgcactccaacgtgcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccatttttcttgacttcttcgggctctagccagactctccagagacaggtgtgtgcttggcctaccctgccaaaaatccatggcataggacacagcaggtccttaagctatggtggcttgctccctttgctgtagtggagatgcttggcagatactcagtaggtagtcttgctaggtccaaggagagggccccagacattgtggaaagtagagtgtgaggcaaaattgcagtggcagtggcaccaaatcttggcttttcacatgggaatatcaagcagtggactcaggcttctcagaagcacttatatgaattttaaccctgttgcattgctttatggagttaatagaatgcaggctgctggtagagtgtagcttgacccagtagcatgtaaacgggactgtgtgactgttgtctgttcaggtggtgaacagaaggctctgtgtccctggcaccatggaagtttcccgggtgattggcttggaaatatagaaggagctaagccttggaggtgatgacagtcacctcacgggtcagttttcaccacatttacacacttacctgtgtctgcagacagtgaaactttgatggacaagctgggtgcatgagacttgcagacctgtgtctcgatagatttgttgaaataacttttgtaggaatctcccctttggtaggtgctgttgctttggatgttgttgaagggatatccttggtatatttggatattgttgtcagcctccttggcaaggtaaaagggaaagtctaggaacagttcttgcacccacagccttaagagaaccatcttggtgagggaccctctaaattagagaccaaggtgtcatgggacctttcttttcgatgttttggcctaactcttatggaaagacaagttgctagtgtgcataggaaggaggtttcaacagggcacatggtgttttgcaaatccaccttgagagccatgctcattagaatcatcagggagaaaataagttcttgaatgcagactgcatttgacacactaagataacttgagtcaagttggatcctggcctgtgatagttctgcaaaatgggattttcattagtgtgagaaggtgaacagtatagtctgagaagttttgaccagaagagatcaaagcagggatggatggcaaaaagcaatctcatgacaaggtggaagtcttcacaacagacaaaatgagcactggacaggtggacataaatagggatggctgccacagcaaggaatgtctcagggtaaaagacacacactcacaccacacacacacacacacacacacacacacactaacacagagagaaagagagagagggggggttcctttaagctgtgaaaatgaagcctgcttcccatgagctggaattttgaaccctcagaggagtttgattttacctcatgcaaagacccagaagtaatgatcagagaaggactggagccatgattgaaggctcaaaagttgttggcttagatatccatggaggcccaattttgctggagggcttattcagagctgcctcctccttcttcgtcagcataggcaaggggacctatgattgcccttggtataggcttcttctgactggatgcttggagaagagccttcattcctttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggcctgggagtaacagcaagtgagatctggaagggcagtgtgaagaggttggtaagagcagttgtgttgagggtgcctgtgagatatgacaagcccatagtacatggtaagcccataatccatgtggttttgcattggtcccactgtaatcggggcattttttccgtgctgtcttcacagggttgcattccctttccagcatggtccatggaaaacatgcagaggaaatggcctcacagcattggctgagtgtttatgtcgtccaaccgagtctccatcgaacttttctggtgttgctgacttgccctaggtcacctgagttaaaaggtaaggaacatgggaattgctgcatgaattctaggtgcccaggtcttggtggagcagggaacggctgccattgatatgtacaggcccttcgggacctggaacatgcctggggcctcatatttctcccaggtttggagcttcggcccattgttccctggcagtggattgtcagtgtccagcagtccattgctctacccaaagccagagcactccagagtactggaaccacttgatgcaatgcactgcaacgtgcttggatctatgatgattcccagtcaaacattccttggaaaagctgaacaaaatgagtgaaaactctgtaccgccactgtcattggaactgaggtccagcatcttgggtctcccaggtgctatgggcgtcaggcacaggctgcccaatgttgggagccgcgcccacattcgccgttacaagatggcgctgacagctgtgttctaagtggtaaacaaataatctgcgcatgtgccgagggtggttcttcactccatgtgctctgccttccccgtgacgtcaactcggccgatgggctgcagccaatcagggagtgacacgtccgaggcgaaggataattctcctaaaaaagggacggggtttcgttttctctctctcttgcttcttacgctcttgcttcttgcactctggctcctgaagatgtaagcaataaagctttgccgcagaagattctggtctgtggtgttcttcctggccggttgtgagaacgcgtctaataacaattggtgccgaattccgggacgagaaaaaaactcgggactggcgcaaggaagatccctcattccagaaccagaactgcgggtcgcggtaataaaggttcccgtaaaacagactgttaagaaggattcaactgtatgaattcagaacttttcagctggggaacgagagtaccagtgagtacagctttacgaggtaagtctgatcttgaactttctaaggaaattcaagacagtctatcagaagtaaagtggaatatgtttggccttgaattttttctaatgttaggagcccttttgttccttttcacatgttatcaagtggttaagatagggcggattctagatgaaattcaggacaagctatcagaagtaaagcggggagagagagtaggagcaaagagaaaatatggtacacaaaataagtatacaggcctttccaagggtcttgaacccgaggaaaagttaaggttaggtaggaatacctggagagagattagaagaaaaagaggaaaaagggaaaagaagaaagatcaattagcggaggtctctaggagatactcgtcactagatgagctcaggaagccagctcttagtagttctgaagcagatgaagaattctcctctgaggaaacagactgggaggaagaagcagcccattaccagccagctaattggtcaagaaaaaagccaaaagcggctggcgaaggccagtttgctgattggcctcagggcagtcggcttcaaggtccgccctatgcggagtccccgccctgcgtagtgcgtcagcaatgcgcagagaggcagtgcgcagagaggcagtgcgcagactcattcattcccagagaggaacaaaggaaaatacaacaggcatttccggtctttgaaggagccgagggtgggcgtgtccacgctccggtagaatacttacaaattaaagaaattgccgagtcggtccgtaaatatggaaccaatgctaattttaccttggtgcagttagacaggctcgccggcatggcactaactcctgccgactggcaaacggttgtaaaagccgctctccctagtatgggcaaatatatggaatggagagctctttggcatgaaactgcacaagcgcaggcccgagcaaacgcagctgctttgactccagagcagagagattggacttttgacttgttaacgggtcagggagcttattctgctgatcagacaaactaccattggggagcttatgcccagatttcttccacggctattagggcctggaaggcgctctctcgagcaggtgaaaccactggtcagttaacaaagataatccagggacctcaggaatccttctcagattttgtggccagaatgacagaggcagcagagcgtatttttggagagtcagagcaagctgcgcctctgatagaacagctaatctatgagcaagccacaaaggagtgccgagcggccatagccccaagaaagaacaaaggcttacaagactggctcagggtctgtcgagagcttgggggacctctcagcaatgcaggtttagcggctgccatccttcaatcccaaaaccgctccatgagcagaaatgatcagaggacatgttttaactgcggaaagcctgggcattttaagaaagattgcagagctccagataaacagggagggactctcactctttgctctaagtgtggcaagggttatcatagagctgaccagtgtcgctctgtgagggatataaagggcagaattcttcccccacctgatagtcaatcagcttatgtgccaaaaaacgggtcatcgggccctcggtcccagggccctcaaagatatgggaaccggtttgtcaggacccaggaagcagtcagagaggcgacccaggaagacccacaagggtggacctgcgtgccgcctccgacttcctattaatgcctcaaatgagtattcagccggtgccagtggagcctataccatccttgcccccgggaaccatgggccttattctcggccggggttcactcaccttacagggcttagtagtccaccctggagttatggattgtcaacattcccctgaaatacaggtcctgtgctcaagccctaaaggcgttttttctattagtaaaggagataggatagctcagctgctgctcctccctgataataccagggaaaaatctgcaggacctgagataaagaaaatgggctcctcaggaaatgattctgcctatttggttgtatctttaaatgatagacctaagctccgccttaagatcaacggaaaagagtttgaaggcatccttgataccggagcagataaaagtataatttctacacattggtggcccaaagcatggcccaccacagagtcatctcattcattacagggcctaggatatcaatcatgtcccactataagctccgttgccttgacgtgggaatcctctgaaggacagcaagggaaattcataccttatgtgctcccactcccggttaacctctggggaagggatattatgcagcatttgggccttattttgtccaatgaaaacgccccatcaggagggtattcaactaaagcaaaaaatatcatggcaaagatgggttataaagaaggaaaagggttaggacatcaagaacagggaaggatagagcccatctcacctaatggaaaccaagacagacagggtctgggttttccttagcggccattggggcagcacgacccataccatggaaaacaggggacccagtgtgggttcctcaatggcacctatcctctgaaaaactagaagctgtgattcaactggtagaggaacaattaaaactaggccatattgagccatctacctcaccttggaatactccaatttttgtaattaagaaaaagtcaggaaagtggagactgctccatgacctcagagccattaatgagcaaatgaacttatttggcccagtacagaggggtctccctgtactttccgccttaccacgtggctggaatttaattattatagatattaaagattgtttcttttctatacctttgtgtccaagagataggcccagatttgcctttaccatcccctctattaatcacatggaacctgataagaggtatcaatggaaggtcttaccacagggaatgtccaatagtcctacaatgtgccaactttatgtgcaagaagctcttttgccagtgagggaacaattcccctctttaattttgctcctttacatggatgacatcctcctgtgccataaagaccttaccatgctacaaaaggcatatccttttctacttaaaactttaagtcagtggggtttacagatagccacagaaaaggtccaaatttctgatacaggacaattcttgggctctgtggtgtccccagataagattgtgccccaaaaggtagagataagaagagatcacctccataccttaaatgattttcaaaagctgttgggagatattaattggcttagaccttttttaaagattccttccgctgagttaaggcctttgtttagtattttagaaggagatcctcatatctcctcccctaggactcttactctagctgctaaccaggccttacaaaaggtggaaaaagccttacagaatgcacaattacaacgtattgaggattcgcaacctttcagtttgtgtgtctttaagacagcacaattgccaactgcagttttgtggcagaatgggccattgttgtggatccatccaaacgtatccccagctaaaataatagattggtatcctgatgcaattgcacagcttgcccttaaaggtctaaaagcagcaatcacccactttgggcaaagtccatatcttttaattgtaccttataccgctgcacaggttcaaaccttggcagccacatctaatgattgggcagttttagttacctccttttcaggaaaaatagataaccattatccaaaacatccaatcttacagtttgcccaaaatcaatctgttgtgtttccacaaataacagtaagaaacccacttaaaaatgggattgtggtatatactgatggatcaaaaactggcataggtgcctatgtggctaatggtaaagtggtatccaaacaatataatgaaaattcacctcaagtggtagaatgtttagtggttttagaagttttaaaaacctttttagaaccccttaatattgtgtcagattcctgttatgtggttaatgcagtaaatcttttagaagtggctggagtgattaagccttccagtagagttgccaatatttttcagcagatacaattagttttgttatctagaagatctcctgtttatattactcatgttagagcccattcaggcctacctggccccatggctctgggaaatgatttggcagataaggccactaaagtggtggctgctgccctatcatccccggtagaggctgcaagaaattttcataacaattttcatgtgacggctgaaacattacgcagtcgtttctccttgacaagaaaagaagcccgtgacattgttactcaatgtcaaagctgctgtgagttcttgccagttcctcatgtgggaattaacccacgcggtattcgacctctacaggtctggcaaatggatgttacacatgtttcttcctttggaaaacttcaatatctccatgtgtccattgacacatgttctggcatcatgtttgcttctccgttaaccggagaaaaagcctcacatgtgattcaacattgccttgaggcatggagtgcttgggggaaacccagactccttaagactgataatggaccagcttatacgtctcaaaaattccaacagttctgccgtcagatggacgtgacccacctgactggacttccatacaaccctcaaggacagggtattgttgagcgtgcgcatcgcaccctcaaagcctatcttataaaacagaagaggggaacttttgaggagactgtaccccgagcaccaagagtgtctgtgtctatggcactctttacactcaattttttaaatattgatgttcatggccatactgcggctgaacgtcattgtacagagccagataggcccaatgagatggttaaatggaaaaatgtccttgataataaatggtatggcccggatcctattttgataagatccaggggagctatctgtgttttcccacagaatgaagacaacccattttggttaccagaaagactcacccgaaaaatccagactgaccaagggaatactaatgtccctcgtcttggtgatgtccagggcgtcaataataaagagagagcagcgttgggggataatgtcgacatttccactcccaatgacggtgatgtataatgctcaagtattctcctgcttttttaccactaactgggaactgggtttggccttgattcagacagccttggctctgtctggacaggtccagacgactgacaccattaacactttgtcagcctcagtgactacagtcatagataaacaggcctcagctaatgtcaagatacagagaggtctcatgctggttaatcaactcatagatcttgtccagatacaactagatgtattatgacaaataactcagcagggatgtgaacaaaagtttccgggattgtgtgttatttccattcagtatgttaaatttactagggcagctaatttgtcaaaaagtctttttcagtatatgttacagaattggatggctgaatttgaacagatccttcgggaattgagacttcaggtcaactccacgcgcttggacctgtccctgaccaaaggattacccaattggatctcctcagcattttctttctttaaaaaattgggtgggattaatattatttggagatacactttgctgtggattagtgttgcttctttgattggtctgtaagcttaaggcccaaactaggagagacaaggtggttattgcccaggcgcttgcagctctagaacatggtgctccccctgatatatggttatctatgcttaggcaataggtcgctggccactcagctcttatatcccacgaggctagtctcattgcacgggatagagtgagtgtgcttcagcagcccgagagagttgcacggctaagcactgcaatggaaaggctctgcggcatatatgagcctattctagggagacatgtcatctttcatgaaggttcagtgtcctagttcccttcccccaggcaaaacgacacgggagcaggtcagggttgctctgggtaaaagcctgtgagcctaagagctaatcctgtacatggctcctttacctacacactggggatttgacctctatctccactctcattaatatgggtggcctatttgctcttattaaaaggaaagggggagatgttgggagccacgcccacattcgccgttacaagatggcgctgacagctgtgttctaagtggtaaacaaataatctgcgcatgtgccgagggtggttcttcactccatgtgctctgccttccccgtgacgtcaactcggccgatgggctgcagccaatcagggagtgacacgtccgaggcgaaggataattctcctaaaaaagggacggggtttcgttttctctctctcttgcttcttacgctcttgcttcttgcactctggctcctgaagatgtaagcaataaagctttgccgcagaagattctggtctgtggtgttcttcctggccggtcgtgagaacgcgtctaataacagcccaacaactccattgttcttgacttcttcgggctctagccagactctccaaagacaggtgtgtgcttggcctactctgccaaaaatccatggcgtaggacacagcaggtccttaagctctggtggcttgctccctttgctgtagtggagatgcttggcagattctcagtaggtagtcttgctaggtccaaggagagggccccagccattgtgaaaattagactgtgaggcaaaagtagcggtggcagtggcaccaaatcttggcttttcacatgggaatatcaagcagtggactcaggcttctcagaagcacttatatgaattttaaccctgttgcattgctttatgtagtcaatagaatgcacgctgctggtagagtgtagcttgacccagtagcatgtaaacgggactgtgtgactgttgtctgttcaggtggtgaacagaaggctctgtgtccctggcagcttggaagtttcccgggtgattggcttggaaataagaaggagctaagccttggaggtgatggcaggcacctcacgggtcagtttgcaccacatttacacacttacctgtgtctgtagattgatgaaactttgatggactcgctggaagcatgagacttgcagacctgtgtctcgatagatttgttgaaataacttttgtaggaatctccactttggtaggtgctgttgctttggatgttgttgaagggatatcctgggtatatttggatattgttgtcagcctccttgtcaaggtcaaagggaaagtctaggaacagttcttgcacacacagcctaaggagaaccatcttggtgagggacactctaaattagagaccaaggtgtcatgggacctttcttttcgatgttttggccttactcctctggaaagacaagttgctagtgtgcataggaaggaggtttcaacagggcacatcgtgttttgcaaatccaccttgagagccatgctcatgggaatcatcagggagaaaataagttcttggatgcagactgcatttgacactctaagataacttgagtcaagttggatcctggcctgtgatagttctgcacaatgggattttcattagtgtgagaagctgagcagtacagtctgagaagttttcacaagaagagatcaaagcaggggtggatggccaaaagcaatctcatgagagaggtgaaagtcttcacaacagacaaaatgagcactggacaggtggacagaaatagggactggctagcacagcaaggaatgtctcagtgtaaaagccacacacacacacacacacacacacacacacacacacgcgcgcacacacacacacacgcacacactaacacagagagagggaccgagagggggtttcctttcaactgtgaaaatgaagcctgcttcccatgagctggaatcctgaactctcagaggagtttgattttacctcatgcaaagacccagaattaattatcagagaaggactggagccatgattgaaggctcaaaagttgttggcttagatatctttggggacccaattttgctggtggacttattcagagctgcctcctccttcttcatcagcatagccaagaggacctatgattgcgcttgttattggatttttctgactggatgcttggagaagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggcccgagagtaacagcaagtgagatctgtaagggcagtgtgaaggggttggtaagagcaggagtgtagagggtgcctgtgagatatgacaagcccatagtacatggtaagcccataatccatgcggattttcattggtcccactgtaatcggggcatgatctctgtgctgtcttcacagggttgcattccctttccagtatggtccatggaaaacatgcagaggaaatggccccacagcattggctgagtgtttatgtcgtccaaccgagtctccatcgaactgttgtggtgttgctgacttgccctaggtcacctgagttaaaaggtaaggaacatgggaattgctgcatgaattgtaggtgctcaggtcttggtggagcagggaacggctgccattgaatgtgtccaggcccttcgggacatggagcatgcctagggcctctggtttctcccatgtttggagcttcggcccattgttccctggcagtggattgtcagtgtccagcagtccattgctctacccaaagccagaacactccagagtactggaaccacttgatgcaatgcactccaacgtgcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccatttttcttgacttcttcgggctctagccagactctccagagacaggtgtgtgcttggcctaccctgccaaaaatccatggcataggacacagcaggtccttaagctatggtggcttgctccctttgctgtagtggagatgcttggcagatactcagtaggtagtcttgctaggtccaaggagagggccccagacattgtggaaagtagagtgtgaggcaaaattgcagtggcagtggcaccaaatcttggcttttcacatgggaatatcaagcagtggactcaggcttctcagaagcacttatatgaattttaaccctgttgcattgctttatggagttaatagaatgcaggctgctggtagagtgtagcttgacccagtagcatgtaaacgggactgtgtgactgttgtctgttcaggtggtgaacagaaggctctgtgtccctggcaccatggaagtttcccgggtgattggcttggaaatagagaaggagctaagccttgaaggtgatgacagtcacctcacgggtcagtttgcaccacatttacacacttacctgtgtctgcagacagtgaaactttgatggacaagctgggtgcatgagacttgcagacctgtgtctcgatagatttgttgaaataacttttgtaggaatctcccctttggtaggtgctgttgctttggatgttgttgaagggatatccttggtatatttggatattgttgtcagcctccttggcaaggtaaaagggaaagtctaggaacagttcttgcacccacagccttaagagaaccatcttggtgagggaccctctaaattagagaccaaggtgtcatgggacctttcttttcgatgttttggcctaactcttatggaaagacaagttgctagtgtgcataggaaggaggtttcaacagggcacatcgtgttttgcaaatccaccttgagagccatgctcattagaatcatcagggagaaaataagttcttgaatgcagactgcatttgacacactaagataacttgagtcaagttggatcctggcctgtgatagttctgcaaaatgggattttcattagtgtgagaaggtgaacagtatagtctgagaagttttgaccagaagagatcaaagcagggatggatggcaaaaagcaatctcatgacaaggtggaagtcttcacaacagacaaaatgagcactggacaggtggacataaatagggatggctgccacagcaaggaatgtctcagggtaaaagacacacactcacacacacacacacacacacacacacacacacacacacacactaacacagagagaaagagagagagggggggttcctttaagctgtgaaaatgaagcctgcttcccatgagctggaattttgaaccctcagaggagtttgattttacctcatgcaaagacccagaagtaatgatcagagaaggactggagccatgattgaaggctcaaaagttgttggcttagatatccatggaggcccaattttgctggagggcttattcagagctgcctcctccttcttcgtcagcataggcaaggggacctatgattgcccttggtataggcttcttctgactggatgcttggagaagagccttcattcctttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggcctgggagtaacagcaagtgagatctggaagggcagtgtgaagaggttggtaagagcagttgtgttgagggtgcctgtgagatatgacaagcccatagtacatggtaagcccataatccatgtggttttgcattggtcccactgtaatcggggcattttttccgtgctgtcttcacagggttgcattccctttccagcatggtccatggaaaacatgcagaggaaatggcctcacagcattggctgagtgtttatgtcgtccaactgagtctccatcgaacttttctggtgttgctgacttgccctaggtcacctgagttaaaaggtaaggaacatgggaattgctgcatgaattctaggtgcccaggtcttggtggagcagggaacggctgccattgatatgtacaggcccttcgggacctggaacatgcctggggcctcatatttctcccaggtttggagcttcggcccattgttccctggcagtggattgtcagtgtccagcagtccattgctctacccaaagccagagcactccagagtactggaaccacttgatgcaatgcactgcaacgtgcttggatctatgatgattcccagtcaaacattccttggaaaagctgaacaaaatgagtgaaaactctgtaccgccactgtcatcggaactgaggtccagcatcttgggtctcccaggtgctatgggcgtcaggcacaggctgcccaacaactccattgttcttgacttcttcgggctctagccagactctccaaagacaggtgtgtgcttggcctactctgccaaaaatccatggcgtaggacacagcaggtccttaagctctggtggcttgctccctttgctgtagtggagatgcttggcagattctcagtaggtagtcgtgctaggtccaaggagagggccccagccattgtgaaaattagactgtgaggcaaaagtagcggtggcagtggcaccaaatcttggcttttcacatgggaatatcaagcagtggactcaggcttctcagaagcacttatatgaattttaaccctgttgcattgctttatgtagtcaatagaatgcacgctgctggtagagtgtagcttgacccagtagcatgtaaacgggactgtgtgactgttgtctgttcaggtggtgaacagaaggctctgtgtccctggcagcttggaagtttcccgggtgattggcttggaaataagaaggagctaagccttggaggtgatggcaggcacctcacgggtcagtttgcaccacatttacacacttacctgtgtctgtagattgatgaaactttgatggactcgctggaagcatgagacttgcagacctgtgtctcgatagatttgttgaaataacttttgtaggaatctccactttggtaggtgctgttgctttggatgttgttgaagggatatcctgggtatatttggatattgttgtcagcctccttgtcaaggtcaaagggaaagtctaggaacagttcttgcacacacagcctaaggagaaccatcttggtgagggacactctaaattagagaccaaggtgtcatgggacctttcttttcgatgttttggccttactcctctggaaagacaagttgctagtgtgcataggaaggaggtttcaacagggcacatcgtgttttgcaaatccaccttgagagccatgctcatgggaatcatcagggagaaaataagttcttggatgcagactgcatttgacactctaagataacttgagtcaagttggatcctggcctgtgatagttctgcacaatgggattttcattagtgtgagaagctgagcagtacagtctgagaagttttcacaagaagagatcaaagcaggggtggatggccaaaagcaatctcatgagagaggtgaaagtcttcacaacagacaaaatgagcactggacaggtggacagaaatagggactggctagcacagcaaggaatgtctcagtgtaaaagccacacacacacacacacacacacacacacacacacacacgcgcacacacacacacacacacactaacacagagagagggaccgagagggggtttcttttcaactgtgaaaatgaagcctgcttcccatgagctggaatcctgaactctcagaggagtttgattttacctcatgcaaagacccagaattaattatcagagaaggactggagccatgattgaaggctcaaaagttgttggcttagatatccttggaggcccaattttgctggtggacttattcagagctgcctcctccttcttcgtcagcataggcaaggggatctatgattgcccttgttattggctttttctgacgggatgcttggagaagagccttcattcccttgaaaactttgctcaggacactggtggaggaagttgatggcatggacctaagagatagtgttgagtacctgtattgcagctcacatatcatccttcagtccttagagtgagctgaggacccagcaagcacttgagagcaaagggcatggcacgatcacatccaaggcctgagagtaacagcaagtgagatctggaagggcagtgtgaagaggttggtaagagcaggagtgtggagggtgcctgtgagatatgacaagcccatagtacatggtaagcccataatccatgtggttttgcattggtcccactgtaatcagggcatgttctctgtgttgtcttcacagggttgcattccctttccagtatggtccatggaaaacatgcagaggaaatggccccacagcattggctgagtgtttatgtcttccaaccgagtctccattgaactgttgtggtgttgctgacttgccctaggtcacctgagttaaatggtaaggaacatgggaattgctgcatgaattctaggtgcccaggtcttggtggagcagggaacagctgacattgattatggccaggcccttcgggacatggagcatgcctagggcctctggtttctcccatgtttggagcttcagcccattgttccctggcagtggattggcagtgtccagcagtccattgctctccccaaagccagagcactccatagtactggaaccacttgatgcaatgcactgcaacgtgcttggatctatgatgattcccagtcaaacattccttggaaaagctgaacaaaatgagtgaaaactctgtaccgccactctcatcggaactgaggtccagcatcctgggtctcccaggtgctatgggcgtcaggcacaggctgcccaaccactccatgttcttgagttctttgggctctagccagactctccagagacaggtgtgtgcttggcctactctgccaaaaatccatggcagaggacacagcaggtctttaagctctggtggcttgctccctttgctgtagtggagatgcttggcagataatcagtaggtagtcgtgctaggtccaaggagaaggccccagccattgtggaaagtagactgtgaggcaaaaatagcagtggcagtggcaccaaatcttggcttttcacatgggaatatcaagcagtggactcaagcttctcagaagcacttatatgaattttaaccctgttgcattgctttacatagtaatagaatgcacgctgctggtagagtgtagcttgaccagtagcatgtaaaagagactgtgtgactgttgtcagttcagttggtgaacagaagtctctgtgtccctggcagcttggaagtttccccgggcgattggctaggaaatagagaaggagctaagccttggaggtgatggcaggcacctcaagggtcagtttgcaccacatttacacacttacctgtgtctgtagatggatgaaactttgatggactcgctgggagcatgagacttgcagacctgtgtctcgatagatttgttgaaataacttttgtaggaatctcctctttggtatgtgctgttgctttggatgttgttgaagggatatccttggtatatttggacattgttgtcagcctccttggcaaggtcaaagggaaagtctaggaacagttcttgcacccacagccttaggagaaccatcttggtgagagaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttgggtgcagactgcatttgacacactaagataacttgagtcaagttggatcctggcctgtgatagttctgcacaatgaaattttctttagtgtgagaagctaagcagtatagtctgagaagttttcaccagaaaagatcaaagcaggggtggatggccaaaagcaatctcatgagagaggtggaagtcttcacaacagacaaaatgagcactggacaggaggacagaaatagggactggctgccacagcaaggaatgtctcagggtaaaagacacacacacacacacacacacacacacacacacacacattaacacagagaatgggagagagtggggggttcctttcagctgtgaaaatgaagcctgcttcccatgagctggaattctgaactctcagaggagtttgattttacctcatgcaatgacccagaagtaatgatcagagaaggactggagccatgattgaaggctcaaaagttgttggcttagatatccttggaggcccaattttgctggtgaacttattcagagctgcctcctccttcttcgtcagcataggcaaggggacctatgattgcccttgttattgactttttctgactggatgcttggagaagagccttcattcccttgaaaactttgctcaggacactggtggaggaagttgatggcatggacctaagagaaagtgttgagtacctgtattgcagctcacatatcatccttcagtccttagagtgacctgaggacccagcaaacacttgagagcaaagggcatggcacgatcacatccaaggcctgagagtaacagcaagtgagatctggaagagcagtgtgaagaggttggtaagagcaggagtgttgagggtgcctgtgagatatgagaagcccatagtacatggtaagcccataatccatgtggtattgcattggtcccactgtaatcggggcatgttctctgtgttgtcttcacagggttgcattccctttccagtatggtccatggaaaacatgcagaggaaatggccccacagcattggctgagtgtttatatcttccaaccgagtctccatcgaactgttgtggtgttgctgacttggcctaggtcacctgagttaaaaggtaaggaacatgggaattgctgcatgaattctaggtgcccaggtcttggtggagcagggaacggctgccattgattatgtccaggcccttagggacatggagcatgcctagggcctctggtttctcccatgtttggagcttcggcccattgttccctggcagtggattggcagtgtccagcagtccattgctctccccaaagccagagcaatccagagtactggaaccacttgatgcaatgcactccaacgtgcttagatctatgatgattcccagtcaaacattccttggaaaagctgaacaaaatgagtgaaaactctgtaccgccactctcatcggaactgaggtccagcatcctgggtctcccaggtgctatgggcgtcaggcacaggctgcccaaccactccatgttcttgagttcttcgggctctagccagactctccagagacatgtgtgtgcttggcctactctgccaaacatccatggcagaggacacagcaggtctttaagctctggtggcttgctccctttgctgtagtggagatgcttggcagatactcagtaggtagtcgtgctaggtccaaggagaaggccccagccattgtggaaaatagactgtgaggcaaaaatagcagtggcagtggcaccaaatcttggcttttcacatggggatatcaagcagtggactcaggcttctcagaagcacttatatgaattttaaccctgttgctttgctttacgtagtaatagaatacacgctgctggtagagtgtagcttgaccagtagcatgtaaactggactgtgtgactgttgtcggttcagttggtgaacagaagtctctgtgtccctggcagcttggaagtttcccgggcgattggcttggaaatagagaaggagctaagccttggaggtgatggcaggcaccccacgggtcagtttgcaccacatttccatacttacctgtgtctgtagacggatgaaactttgatgtactcactgggagcatgagacttgcagacctgtgtctcgatagatttgttgaaataatttttgtaggaatctcctctttggtaggtgttgttgctttggatgttgttgaagggatatccttggtatatttggacattgttgtcagcctccttggcaaggtcaaagggaaagtctcggaacagttcttgcacccacagccttaggagaaccatcttggtgagagaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggactgtgatagttctgcacaatgggattttcattagtgtgagaagctgagcagtatagtctgaaaagttttcaccagaagagttcaaagcaggggaggatggccaaaagcaatctcatgagagaggtggaagtcttcacaacagacaaaatgagcactggacaggtggacagaaatagggactggctaccacagcaaggaatgtctcagggtaaaagacacacacacacacacacacacacacacacacacacacacacacacacactaacacagagagagggagagaggggggttcttttcagctgtgaaaatgaagcctgcttcccatgagctggaattctgaaccctcagaggagtttgattttacctcatgcaaagacccagaagtaatgatcagagaaggactgtagccatgattgaaggctcaaaagttgtttgcttagatatccatggagacccaattttgctggtggacttattcagagctgcctcctccttcttcatcagcataggcaaggagacttatgattgcccttgttattggctttttctgactggatgcttggagaagagccttcattcccttgaaaactttgctcaggacactggtggaggaagttgatggcatggacctaagagaaagtgttgagtacctgtattgcagctcacatatcatccttaagtccttagagggagctgaggacccagcaagcacttgagagcaaagggcatggcatgttcacatccaaggcccgagaataacagcaagtgagatctggaagggcagtgtgaagaggttggtaagagcaggagtgttaagggtgcctgtgagatatgacaagcccatagtacatggtaaacccataatccatgtggttttgtattggtcccactgtaatcggggcatgttctctgtgctgtcttcacagggttgcattccctttccagtatggtccatggaaaacatgcagaggaaatggccccacagcattggctgagtgtttatgtcatccaaccgagtctccatcgaactgttgtggtgttgctgacttgccctaggtcacttgagttaaatggtaaggaacatgggaattgcttcatgaattctaggttcccaggtcttggtggatcagggaatggctgccattgatatgtccaggcccttcgggacatggagcatgcctagggcctctggtttctcccatgtttggagcttcggcccattgttccctggcagtggattggcagtgtccaacagtccgttgctctccccaaagccagagccctccagagtactggaaccactttatgcaatgcactgcaacgtgcttggatctatgatgattcccagtcaaacattccttggaaaagctgaacaaaatgagtgaaaactctgtaccgccactctcatcgaaactgaggtccagcatcttgggtctcccacgtgctatggtcgtcaggcacaggctgcacaaccactccattgttcttgacttcttcgggctatagccagactctccagagacaggtgtgtgcttggcatactctgccaaaaatacatggcataggacacagcaggtccttaagctctggtggcttgctccctttgctgtagtggagatgcttggcagatactcagtaggtagtcgtgcaaggtccaaggagagggccccagccattgtggatagtagactgtgaggcaaaagtagcagtggcagtggcaccaaatcttggcttttcacatgtgtatatctggcagtggactcaggcttctcagaagcacttatatgaattttaaccctgttgcattgcttacgtagtcaatagaatgcaggctgctggtagaatgtagcttgacccagtagcatataaacgggactgtgtgactgttgtctgttcaggtggtgaacagaagcctctgtgtccctggcagcttggaagtttcccgggcgattggcttggaaatagagaaggagctaagccttggaggtgatggcaggcacctcaagggtcagtttgcaccacatttacacacttacctgtgtctgtagatggatgaaactttgatggactcgctgggagcatgagacttgcagacctgtgtctcgatagatttgttgaaataacttttgtaggaatctcctctttggtatgtgctgttgctttggatgttgctgaagggatattcttggtatatttggacattgttatcagcatccttggcaagttcaaagggaaagtctaggaacagttcttgcacccacagccttaggagaaccatcttggtgagggaccctctaaattagagaccaaggtgtcatgggacctttctttttgatgttttggcctaaacttctggaaagacaagttgctagtgtgcataggaaggaggtttcaacagggcacatagtgttttgtaaatccaccttgagagccatgctcatgggaatcatcagggagaaaataatttcttggatgcagactgcatttgacacactaagataaaatgagtcaagttggatcctggcttgtgatagttctgcacaatgatattttcattagtgtgggaagctgagcagtatagtttgataacttttcaccagcagagatcaaagcaggggtggatggccaaaagcaatgtcttgagagaagtggaagtcttcacaacaggcaaattgagcactggacagttggaccgaaataggcactggctgccacagcaaggaatgtctcagggtaaaagacacacacacacacacacacacacacacacacacacacacacacacaaacacacacatacacacacactcactaacacagagagagggagagagacggggggttcttttcagctgtgaaaatgaagcctccttcccatgagctggaattctgaaccctcagaggagtttgattttacctcatgcaaagacccagaagtaatgatcagagaaggactggagccatgattgaaggctcaaaagttgtttgcttaggtatccatggaggcccaattttgctggtggacttattcaggacactggtggcggaagttgatggcatggacctaagagaaaatgttgagtacctgtattgcagctcacatatcatccttaagtccttagagggagctgaggacccagcaagcacttgagagcaaagggcatggcatgttcacatccacatcctcgccagcatctgctgtcacctgaatttttgatcttagcctccctaagtcttaaaatccctttatcaaccctaagccacagaatatcaggcatctccaagtcatttccagtaggccatcttttgataaaaacctcagccaaccattcaaacaaacttttgacaccttttttaactatgtgagcttctgtattaaacctagaatctcttctcagaggacccatgtcaataaactcagcctgctctagttttatgttccttccacccttatcccacacccttaaaatccatttgcacgcatattcacaggttttgcttgaatgaattagcaaactcattaagctccttagtagtgtagcgaatttcctcatggactacactttctacctcccctctaggagcctgttttgctttgagtctggttacaggtctagaagaaactattggtgggccttgagaaacatcagtagtgaaagtcattgctggtttatcagactctgcaaaagtaatttcctcgtgtggggaaggcattatttcaaggggtggggctgagggtactacttcctcaggtggggcaaacccttgagaatctgaagattcaaaattctcagcttcaacatggtcttcccacacatccccgtcccttgttataggatcccattctttgccaattagagcccttactttaactgtcgacacactctgaggctgagacttgaattttcgctgtagttcagccaaccttacaatgagggtttcagtttgattttctgcaacttgagctctattgctacaagagagaagattctcttcaaggacacacttatcaacttttagatcgtttacttgtgtctggagcctttcgattttatcacacaacttcctttcattcatcattttttccacagatactaagagcagccagccagtaaaatcattttccgatttttttccccagctttgtgcactgaatcacctaattcattaagaaaatcaagggcattagcttctttaagttcgaaatgtagtttcaaccatgggttttcaaaattctctgagctcccaggagggagagaatctggagaggtttcaatagttgaaagtgctggtggatcaacaagccaattccagtattttaaaagattcatccttgtacttctgttactctagaaccactcctggtaccaacttctgtattagtcagggttctctagagtcacagaactcttggatagtctctatatagtagaggattttaatgatgacttagagtcggcagcccaattcccaacaattgttcagtcacagctgtgaatggaagtccaaggatctagcagttactcagtctcacacagcaagcaggcgaaggagcaagagctagactcccttcttccaatgtccttatattgtctccagcagaaggtgtagcccagattaaaggtgtgttccaccacagctttaatcccagatgaaaggtgtagcccagattaaaggtgtgttccttaaactcggagatttaatcttctggaatccatagccactatggctcaagatctccataccaagatacagataaggatctccaagcctccagacaagggtcactggtgagcctcccaattctggattgtagttcattccaaatatagtccaattgagaaccaggaatagccactacagtattttactctagatttgctctagtctcatctttaaggaagtgataggaggctaagtctcaccaaacacttgaaagtaatgggagtgctatgttactagacaattgctgagaggaatagagttctcactctggactggatagtccaaggacttggcaggaagtgttgacagcctcaatgtgttctgaccattccaaaatacatattaagcacatcatccatctcaatgtgcatggtgccatctaaatggctgcatatgttctttgttttcttcacagagatgcattccttttccttcatgggccatgagtgacatccagagaaagtgtcaccacaacactggacaaaagttgatgatatctgaatgagctaccagtaaacccccccctttttttgctgttattgccttgcctgaggaaaagcgagttaaaaggtaaggaatgcataaatttcccccaagaattcaaggtgctcaagactttgtggaccaaagtgctactttacagatatcccacagttttgacatgtataataccttggggtccagaacaaattcaggcttcattttcaatagtatacatttctctcagcactactatcttgtaacctcctattagcatagcatactaacctgttcttacagcattccaccattttaagttcaaagttctaaatcattctagaatcctgcaaaaaaaaaaaaaaaagaccagttggttcttcacagcaattcaacattccttttaccaaattctgttttatttagttatttttgctgtaataaatcaccatgactagggaagcttaagaaagaaaggatttaattggaattattgttgtacaggattggagtctttgatggcacaattatccttgacagcaagaacttttgtgatcttatatcttgatatacaaccaaaaggcaaaaagaacactaataatggtatgattctttgaaacccagtgcccacctaacatgacatatctcattcaacacgttcacaacttttaaacctctcacaccaatttcaaactaatgattcaaaccggggagcctatgtagggcattatcattctaactgccataggaaggtttttggtaaatgtagtctgggtttcttttagtcattctcatatatattttatttgtatagaaaatgtaattttaatttcctgaaatgtacaatgttttggtatgctctacatgagtttattggtcaaactgtttaacaggctgatattatcttttaaaaaatctttgtagtgtttttatatatcagtttatattttgtcactaaaaagtatttctttgtatttttctcctcctatctaattaatagactaatcatctcctgatgactcttttcattctttttctagaaaagtatttactcaaaactaagtattcaaaactaagtattttatgtaaatttattttattccaggaatgtagaaaacgtgacaaattattttatctgaaatcattgtcctagaatttaaactataaaataaagaatgaatgaagaaagcatagaatctatagtccctagattgtggttgttacttttaagcttgcaaagaatgtatatgaaaacaaagaaagaacaatgaaaagaagaagaagaagaggaggaggagaaagaagtgaaagaaaaatagaaagaagaagagtaaaaaagaaagaagtagaagcagcagaaacaaaagtggaagagaaggaaaagaaaaagcagaaaaagcagaagaagaaggaaaaggaagaagaggaggaggaggagaagaaaaaagaaaggaaaaaagaaagaagaaaaatgacaccactacatttatgataggaagttataaagtctttttctttttttttttctagccactctatgaatccgtgcttcaaagtgactttccctatgtagtgtaaccatatatgttctatctcatgtaaatgtacagtataatattttccaaccctcttcctctttaggacatgtgttcgttcctaaactctgccatttttcctgtctcctggcagatgatacctacagtgatgagttggagttatagatggtgccatttcttctaccagcagcttcaccaaaacaatctccattatacatgctgatgcctctttcctgtgtagcagcagacaccacctgcagataagaaatgcttaagtgagaaatgctcattttgggatatcatcgctgaaactataatttgggcatggtgactgtttcccttgctgccacttgactcaatctcagaagtttaatagatcaaataatattgtacaatatgctcaaaatggtggaagtaattagtgctcctataaatatatattgacaatttaaatataacatattaaaaataaaatgcatgattaaacaaacctgaatgcatacttatataattaatacataaaatatgtgctgcctcttttttgaaggctatccccatagtttctctctgttaagagaaggatatacatgcttttaagcaataaatatacaagcagatacacatactgtctggtgggggcacttctagtagtaatgccatattattatgcaaattgctacttttgtttgagtctttttgatgagcttttgctactatgtcatttattgaatgactatatgactgttttgtagatgaaatagaattaaatattttaaatattgcttatacatgcatttatataggtgctaattttctgtgcaatagacttccgtatatattaacatttatgcattcatctcctctattaaagtaaatttacctagaacacaaattattgaaattaagtatattgacacttaatatttttataattgttatgattcctttaagaatgtgcttgaagagctttcttgtaagaatcaatgaattagattgcccaatttttcaaaatacaattatggtagattttacaaatgattgagatcctttccagtgtgttagcccaaattgttgctctgacttgtatttattttatttttgagtttgatcattttcatgtttaatagccatctgtattattttaatttcctatttatctcaaaacttgggagtatttagtctctttaatgatcttatagtatttgggaaagataagattttggattgtcaaacattacatgtttgtcacacttttaaactttgttttgttatcagaatgcgtattattcttacatgtccaaatataaccatgtttgcttttatggcttctgagtttcatgtcatttaaaaaaatattctgaacccataaagcttttcacctatgttaattctaattattttgtgttttttaaagtcaaattcttatgtcatgaaaaaaattttattttgaaatcttacagttgcgaagttatttgccattacttataattatttgccaataattgcccacttatctgtaatgccatcttgcatatgtgctgtattctcatccatgaatggctccatttttgttttgtggatatgtgtgtctcttctcccttctgtctcatgtgtcttcttgttggaagaagttacagtatagactgtaatttcatcaatcttaataaattaatctgggaaaaacttgttttaaatgatactgtcttcataaataaggacaaggtatgtctcttttattaaataattaattattgttgatattttcactgtgatgttgggcttttctctcttttttgcttatttatttggttttaaagttttttagattttgttttaggggcatgagttaagtggccctgttacttctttttattatatatataatgtaacaattttgcaaatactgatttttctcccaatccaattgataacaattatggttatgctgataaaactccacaaactggtaatctcagagcacttaagcaattgtggaaatattatcctcccttgatttaaatgggatttcccacaatgctttgtggatatgagtagcacattgctactctcctatatttccaaaaagaccaccttgaaggagcaatgatcaagcaaagttgagtttactaaacttattgcagcaagggaaaacaacaccataatagggcttagtagtggttgaaaggcaaaataacggcctttctacctggactactagggtatgaggcatagacaaaaacaacgaatgggcccaattaagcatgcaatactttaagatggattggggtagaatgtgttcctaatgtgcttcctgaaaagtaaattgctatctaagtgagtctttggcctcaataagatattagcgacagaccaatatttatctatatatgcaaatagaatttatcacttaatagttggtcttgctgagcaggactctactattggtgttatcaggtcttactctcaaaaggtaagttatttttttcatatgactggatgtaagtataaatgtaatattgtaactttaactttgagatatttgatatattatgttaggaagattgtacttccatttttcatattttttaggaatttgaatttaagccagctggaggatgtaattgctactttttacacaaacacttgtactatatttttaataattatttattgccataaaatattttattttcaatcattaggtatccttttattccatgcttgggcatactcatttaattcatttaatttattaactcatttaattcatttaattctctgtatttgatttggacatttttgagttcatatgattaaatgaaatcacttttccattcactttcttatctatttctctcattcatttgtgttagaatttcttattatgtttaagtaatgtagtgaattttcatctgtgcagtgatcaatgggttgtgaccatggttaattatgcacatccgtgaaatctggtctttgatggataataaaatctctgagttcagatgagatcgggcacgttcagggtggtatggcctattgtcataactggtagaattattttaatccctaatctaaaactctgacattcttgtagtttccctttggcattcagaacataaaacctgtgtgccacaactggcaaaaggccagttatttcctcggacccttgcttggaaaattcaccccattagtgaattagtgcattagttctgttgtggttctgattcaacattctcttgttcctatcaacattgctgtgattttccagtaatccccactttaggaatgtagttttgctctatgtaagatacataaaccatgttgtctacagaactttccaagagggaaactaacgatgatattggtcatgattttggagttaataaatcaacaaataacatgatatgctctaaaaaaaaactctaagcttgttcacattactacatatcatttgtttcatatcagatatataatgtttattatttgctcacagaagattacaatgcactcagattttctatcacactatttatactctatattttcaaatgagtaagttgcacatgtggatttttagaataacccattttcttctttcattcacaatcaagattttagatttttttcaggttttaaaaatgttccaaatacatttatacattttccctatgcatatttcataataattgtttaaaattttaatccattaattttcatttgttcttgataaaaattatgttaccatacatactttctgacataataaacatggcacatgagagataaggaaagtgatgatctctatattaggccaacagcctatgctgttacattattaatctgctgtgtgttcttttttaatttatttattagatatattctttatatacatttcaaatgctatcccgaaagttccctatacctccccctgccctgctcccctacccacccactcccacttcttggccctggtgttccccagtactggggcatataaagtttgcaagacaaaggggcctctcttaccaatgatagccgactaggccatcttctgctacatatgcagctagagccacgagctctgggggtactggttagttcatattgttgttccacctatagggttgcagatccctttagttccttaggtactttctctagctcttccattggggccctgggttccatccaatagctgactgtaagcaaccacttctgtgtttgtcaggcattctgaatgatattttaaaaaccattttaaatgagtggttggttaagtgacttaggtatgtatgacttaatttgaaatcatagaacccatgattgaaaagttgaatgtggtgttacattattatatatgtgtatactgcctttgctagtaatcagacacagcttgatggctctggttcactgtaaaccactctatcttaatcactgaccaccagaaaaatgagagaccctgaattaaaagcaccaacaaacaaaaatattaaacatgctaagacagattattcttaataacaacacctacagctattgttctggcttcatcacagccatattccctgctacaaagcactaccaaacacacatatgcctagtaactcaaacatgcacaaacaaaacattattaaatgagtgaggtttattttaactatttctcccacaaaaaattgcaatattttcattaattatccattccttcattaattctggagggggtgcacacatttgccatagtgcacatgaaaaatcagagggcaacctttatttagatcttctagtatctaggttctagggattgattgcaagacatgaggcttggtcttaagtacatttacctattgaggcaccttggtggctattttaaaacatatttaagtgactttgtgtattaaaaaattcatagtttgcaaactgacttcaaatatttataattcttaactcgaggatctctggccatgctattctttcttctccatagataactagtggtactacatcattctcattgtcacagtatctcccattctctcatacagcctcaattctccaaggtatatatccattagaagtattttccttttttatcaatcatttttattatttaaatttcaaatgatatccaccttccaagatacccatacacaaaatccccataccatcttccatcactcccctcccttttgcctcaatgaaggtgctctttgacccacataaccagtcctgcctcactgctctagaatccccctaagctggaccaagggacttccctcccattcctccctctatgtatactctttacttggtggtttagtccctgagagctctgggtgatccagttaattgatattgttcttatagaattgcaatcctcttcagctatttcaatcttccattggtgcctccagataagcctgattgttgtttgtgagtatctgcatgtgtattagaaaggtgatcatagaatgtctcatggaatagctgtattagactcctgtcagcaagcattttgtgtcattagcaatagtgtaggggtttggtgtctttaaattagatagattcctcagtggaggggtctctgtatggccttttcttcagtttctgttccatttctgggcatatcattcctttggacaggaaaatttctgggttaaaacttttgagatatgtgggtggcaccatccctcgactagggggcatgcctatctactggaggtggtatctacagattgtatctcccctttcttgggtaatttggataaagtcatcaccattgggtcctgggagtcttttgcttccctggagtatcagactttctagaggctaaatccggttccctattccccactgctgcctgtttctatgcagttgatacagttgttcttcctatggagttgcaatcatttcagttccttcgatagtacccctaactcttcgataggggtcccaaacctcagtccaatttttgcctgtaaatatctgcatgtgtctaagtcagctgtggcagatcctctcagaggacagccatgctaggctcctgtatgcaagcataacatgacatcaataatattgtcagagtttggtgcaatgcatgatatggacaccatgttgggcccatcactgggtggcttttgctttagattctgcacaattcttgtctcaacatttcctttagacaactacaattctgagtcaatgaaatttgaagatggatgagtgacaccattcctttacttgaggtcatttctatctactggaaatggttatttcagggtccatctgccgattgttgagcattttgacaaaggtcatcctcattaagtcctgggaactttttatattccaagtctctctgagactttctagagtttccctccacccaatgctgctgcatatttcgatttattctcctggccccctggacttctatgctgtttccccccatatttaatattgtccccctttacaccttccactcttctctctcatcatgatccctggctttctctgactcctttgattgcttttccccttttaaatggattcaagaatccacagttgtgccttctttcatgttaaacttcatagagtctgtgagttttttcatgggtattctgaattttttggctaatatccacttctccctgagtatatgcctgtctttttgggtctaggttaccacattcaggatgatattttgtaattgtgtacatttgcttgaaaagttcatgatgtcttcacttttaatagctgtatattattccactgtaaaaatgaacacattttttgcatccattcttttgttgatagacatcttgggtatttccaccttctggctgttacaaataagggtgctatgtggaatgcctgttcttgtggtatatgggacatcgttgagtatatggccaggagtggtacagttggatcttcaagttgaactatttccaattttctgaagaactgccaggatgattttcagagcagttgttcaagtttgcaattgaaccagcaatggagtactgttcctatttctccacattcttgctagaatgtgctatcaagtgagtttttttatattagccattctgattgttgtattgtggaatctcaagttcattgtgatttacatttccctgataactaagaatgttcaacagttcttttagtgcttcttggaaatatggtattctgttgaaagttcggtgtttaattctgtacccaccttttaaattgagttatttgttttttgaagtctatattcttgtgttctttgtataaaagccctgtatcagattcaatattagtgaagatttttccaaatcagtaggttacattttattctattgacagttttgtttgcctagtaagttttcagtttcatgatgtcccatttctcaatttctggtcttagagactgaaattaaaaaaaatatataatcaacaaaatcataatgtaatggatgttattctagtcagataaaatggagccccagttaaatccagatcaggtaaactataaaaagttccataaaccctaagaaaatagaagcagtcattaaaacctccaaataaagacagaccacggggtatagttcagtcttcaggggattcccagcatacatgcaaggtccccattgctgtcttcagatgtaccagaagagggcatcagatctcattacaggtggttgtgagccaccatgtggttgctggggtttgaactcaggaccttcagaatagcagtcagtgctcttgcccgttgagccatctcaccagaatagcagtcagtgctcttgcccgttgagccatctcaccagcaaactttatatgccccagtacaggggaatgccagggccaaaaaggggcagtgggtgggtaggggattggtggggtgggtatgggggacctttgggatagcattgaaaatgtaaacgaggaaaatacctaattaaaaaaatacaatttaaaaaaaaatatagtccataaaacagcagcaatagcctcatcaggaactagtaataggcaaattctcaggtgctgcagtatttctattgggtcagttgtctgtatcaaaccattgatgcatcaatgatacattgatgcacccagttaatttgcagacatgttcaatcttgagacctttgcactaagtcaaagggtctgtatggggatgtatgtgttagaaactgggcacactctataaatgtaattgttataaagcagtatataaagatactgttcctcattaaaaaaacaacaacaacaacaacaacaaaaaaaaaaaacaacaaaaaaaaaccctccaaataaaataaaggcctgggtgagatggtcttttttatatatatatatatattttattaggtattttcctcatttacatttccaatgctatcccaaaagtcccccataccctccctcccaataccctacccacccactcccacttttttgccctggcattcccctgtactggggcatataaagtttgcaagtacaatgggcctctctttccagtgatggcctactagaccatcttttgatacatatgcagctagagtcaatagctccggggtactggttagttcatattgttgttccacctatagggttgcagatccctttagcttgttgggtactttctctagctcctccattaggggccctgtgatccatccaatagctgattgtgagcatccacttctgtgtttgttaggccctggcatagtctcacaagagacagctatatcagggtcctttccgcaaaatcttgctagtgtatgcaatggtgtcagcgtttggaggctgattatgggatggatccatggatatggcaatctctagatggtccatcctttcgtgtcagctccgaactttgtctctgtaactccttccttgggtgttttgttcccaattctaagaaggggcaaagtgtccacaatttggtcttcgttcttcttgtgtttcatatgttttgcaaattggatcttatatcttgggaattctaagtttctggactaatatccacttatcagtgagtacatatcatgtgatttccttttgtggatgggttacctcactcaggatgatgccctccaggtccatccatttgcctaggaatttcataaaatgcattctttttaatagctgagtagtatcccattgtgtaaatataccacattttctgtatccattcctctgttgacaggcatatgggttcttttcagctcctggctattgtaaataaggctgctataaacatagtggagtatgtgtccttcttaccagttggaacatcttctggatatatgcccaagagaggtattgctggatcctcccgtagtactatgttcagttttctgaggaaccgccagactgatttccagagtggttgtacaagcttgcaatcacacgaacaatggaggagtgttcctctttctccacatccttgctagcatctgctgtcacctggattttttatcttagtcattcagactgctgtgaggtggaatctcagggttgtttatccctgcatttccctgatgattaaggacaccgtacattttttcaggtgcttctcagccattcggtatacctcaggtgacaattcttcgtttagctctgagccccatttttaatggggttatttgattttctggagtctaccttcttgagttctttatatatattggatattagtcccctatctgatttaggataagtaaagatccttttccaatctgatggtggcctctttgttttatttacggtgacttttgccttacaagcattgcaattttatgaggtcccatttgttgattctcgatcttacagcacaagccattgctgttctattcaggaatatttcccctgtgcccatatcttcgaggcttttcctcactttctcctctataagtttcagtgtctctggttttatgtggagtttcttaatccacatagatttgaccttagtacaaggagataggaatggatcaattcgcattcttctacatattaactgccagttctgccagtaccatttgttgaaactactgtctttttttcactggatggttttagctcccttgtcaaagatcaagtgaccataggtgtgtgggttcatttcagtgtcttcaattctattccatttgtctacttgtctgtctctacaccagtaccaggcagtttttatcgcaattgctctgtagtacaacttttggtcaggcatggtgtttccaccagagattcttttatccttgagaagagtttttgctatcctaggttttttgttattccagatacatttgcagattgccctttctaattcgttgaggaattgagttggaattttgatggggattgcattgaatctgtagattgcttttggcaagataaccatttttagtatattgatcgtgacaatcgatgagactgggagatttttccatcttctgagatctttttaatttctttttcacaaacttgaagttcttatcatacagatcttttacttccttagttagagtcatgccaatgtattttatattatttgtgactattgagaagggtgttgtttccataatttctttctcagcctctttatcctttgtgtagagaaaggccattgacttgtttgagttaattttatatccaggtacttcactgaagctgtttatgtggtttaggagttctctggtggaatttttagggacacttatatatactatcatatcatatgcaaaaagtgatattttgacttatttctttccgatttgtatccccttgatctccttttgttttcaaattgctctggctaggacttcaagtacaatcttgaataggaatggagaaagtggtcagctgtgtctagtctctgattttagtgggaatgcttccagcttctcaccattaactttgatgttggctactggtttgctgtagattgcttttatcatggttaggtatgggccttgaattcctgatattaacaaggcttttatcatgaatgggtgttagattttttcaaatgatttctcagcatctaacgaaatgatcatgtggtttttgtctttgagtttgttcatatagtggattacggtgatggatttccatatattaaaccatccctgcatcactggaatgaaacctacttggtcaggacagatgatagttttgatgtgttcttggattcggttagtgagaattttattgaggatttttgaatcgatattcataagggaaatttgtctgaagttctctatctttgttgggtctttctgtggtttagctatcagagtaattgtggattcatagaatgaattgggtagagtaccttctgcttctattttgtggaattgtttgtgcagaattggaattaggtcttctttgaagatctgatagaactctgcactaaacccgtctggtcctgggcttttttgattgggagactatttaggggatatagggctgtttagatcattaacctgatcctgatttaactttggtaccttgtatctctttagaaatttatccatttcatccaggttgtccagttttgttgagtatagccttttgtagaaggatctgatggtgttttggatttcttcaggatctgttgttatgtctcgcttttcatttctgattttgttaatttggatgctgtccctgtgccctctagtgagtctggctaagggtttatatatcttgttgatccagctccttgttcggttgattctttgaaaagttcttcttgtttccacttggttgatttcacccctgagtttgattattttctgccttctactcctcttgggtgaatttgcttccttttgttctagagcttttaggtgcgttgtcaaactgctagtgtacactctctctagtttcttttttgaggcactcagagatatcagttttcctcttagaaatactttcattgtgccacataagtttgggtatgttgtggcttcattttccttaaactctaaaacgtctttaatttctttctttattccttccttgatcaaggtatcattgaggagagtgttgtccattttccacgtgaatgttggctttctattatttatgttgttattgaatatcagccttagtccatggtgatctgaaaggatgcatgggacaatttcaatatttttgtatctgttgaggtctgttttgtgaccaattatgtgggcagttttggagaaggtaccatgaggtgccttttgttttaggaaaaaatgttctgtagatatctgttaaatccatttgtttcataacttctgttagtttcactgtgtccctgtttagcttctgtttccatgatctgtccattgatgaaattggtgtgttgaagtctcccactattattgtgtgaggtgcaatgtgtgctttgagctttactaaagtttctttaatgaatgtgggtgcccttgtatttggagcatagatattcagaattgagtgttcctcttggagggttttacctttgatgagtagagttggcattctgttcttgtggctgtcttcttttaggtttgttgaaggattactttcttgctttttctagggcttgttttctgtctttgtattggatttttttctgttattatcctttgaacgactggattcatcgaaagataatgtgtgaatttgttttttgtcatggaatactttggtttctccaaaattgaaagtttggctgggtatagtagcctggctggcatttttgttctcttagtgtctgtatatcatctgtccaggttcttctggctttcatagtctctggtgaaaagtctggtgtaattctgataggcctgtctttatatgttacttgacccttttcccttactccttttaatattctatctttatttagtgtatttgttgttctgattattatgtgtcaggaggaattttatttctgacccagtctatttggagttctgtagacttcttgtatgttcattggcttctctttctttaggtttgagaagttttcttctataattttgtttaagatatttgctggccctttaagtggaaaatcttcattctcatctactcctattatccgtaggtttggtcttctcattgtgtcctggatttcctggatgttttgagttaggatctttttgcattttgcgttttctttgatcgttgtgctgatgttctctgtggaatcttctgcacctgagattctctcttccatctctcatattctgttgcttccatttttaggtctagtgtgattttgttcatttccatcacctgtttggatgtgctttcctgtttttctttaaggacttctacctgtttggttatgttttcctgtttttctttaaggacatgtaactctttatcagtgttctcctgtatttctttaagtgagttattaaagtccttcttgatgtcctctaccatcatcatgagatatgcttttaaatctgggtctaggttttcagatgtattggggtgcccaggactgggtgaggtgggagtgctgcattctgatgatggtgagtggtcttggtttctgttagtaagattcttacatttgcctttctccatctggtaatctctagagttagtttttatagttgtctctggttagagtttgttcctcacatgattctgttagcctctatcagcagacctggctgagtagctctctcctgagtttcagtggtctgagcactctgtgctggcaagctctcctcttgtagggaaggtgctcagatatatggcgtttggacctgcctcctggcagaagatgaaggcctgaaacagggcctgtcccagaagctgttagcttctgtagtcaacactctcacctgtgcagattagtctcagagtaatccgggaaccaatatggctgcccgaggtgctccagcaaagtcctccttggcagggagcacacctgtcctctggcagggaaggtgcccagatgtctggagctgaaaacagggtctgcctcagaacctgtcctctagtcaccttggggatgtcctctgactcctcctgcaggtgacctggggctggcgcagactggaagggacttgtgaccctggtcagaccgggttttcggcttccctaatgctgtctcaggtcccacacgattggaatggaacagaagttgttttcactcactggtggtcttaagattgcatggagagtcctctagggacctgggggttgggctgtccactgacttcgtgcccaaggtgcttccctaatgctgtctcaggtcctgcatgattggaatggaatagaagttgtgttccactcactggtggtcctaaggtcgcgtggagagtcctctagagaccttgggagggtgtcagccaactctgcaccaggtcgagatggtcttaatacagaattctaccatcccttaaaaaatatctaataccaatactcctcaaactattccacacaacaaaaatgtaaggacctcatcctaattaattctatgtaaccacaggtactccaatatctaaatcacataagaagagaatttcagacaaattttgcttgtgcatatcaatgtaaatatactcaataaaattcccaccaaacaaacctaagaacacttcaaaaccatcaaatactatcatcaagtacacttcatcctagaggtaccaggatagttcaatatacaaaaatcaatgaatgaattccactatataaatacattcaaataaaaatcacatgatgatccaatcatatactaaaaaaggcctttgacaaaatacagcatactttcatgtttaaagtctaggagggatcagaaattcttcacatacatataaacatgttaaaacagtatacaaaagactaacatccaacaaaaaataagtggagaggaattgaagcaatccctctaaaatcaggaagacaaggctgcccactctctccctatatattcaatatagcactctagctatagcaattaaacaaaaggcgatcaaggggatacaagttggaaagaaagaagtaaaggtatcactatttgtgggtgtatgataatatatataatcaaccatagaaattctactagagaactccttcacctgataaacaaattcagaaaagtagccgaatatgaaagtaacttaagcaaatcagtagccttcctttatacaaatggtaaatgggctgagaaagaaattagagaaacatcacctttctttttttcccattttttattaggtatttagctcatttacatttccaatgctataccaaaagtcccccatacccagccacccccactcccctacccacccactccccctttttggccctggcattcccctgtactggggcatataaagtttgcaagtccaatgggcctctctttgcagtgatggccgactaggccatcttttgatacatatgcagctagagacaagagttccggggtactgcttagttcatattgttgttctacctatagggttgcagttttctttagttccttgggtgctttctctagttcctccattgggggcaaactatataagcaatcttggtgtaaatttaaccacccaagtcaaagatccatataagaagaatatcaagtgtctcagaaagaaattgaataaaaagttagaagatggaaagatctcccattctcattgattgataggattaactagtaaaaatggctatcttaccaaaggaaatctacagattcaatgcatttcccatcaaaacgctaacacacttcttcacagacatggttaagggcaattttaaacatcatatggaaaaccaaacaattttcaacagtaaaagaactcctggggggtaatcaccatacctgaccttgaactgtagtacagagcaacagagatgaaaaccacatggtacagacagagacagacaggtcaatcaatggaatagaattgaagacccaggaataaacctatacacctatggaacttgatctttgacaaagaagccaaaagcatacaatggaaaaaagaaaacatcttcaacaatggttctggtctaaatggttgtctgaacgtaacagaatgtgaaatgatccatatttaccattttataaaactcaagtccatgctggtcaaggacctcaacataaaaccagatacactaaacctaatagaagaaaaatggtaaatatccacaaatgcattggcacagggggatatttcttgagaacaccaatagcctgggccctaaggctatttttattgttacatatttcaaaaataaaaaagtgtgcatctaaaagacaaggatattatgtttcaaactgggaactaaatgttgaggtctctatttaatatatcaaaatggacaaagcagtcagattctcccaggatcccttattccttagctgttacagagaatggctagaataccttgcctcctttcctaaaattttcaccccagatgctgagcagcccttccactaggggctgttgcctatataatcctgctcttttgtacctttgacatcatggctacaatacctttttcccttccctcctttttttcttccctccctttgtatgctcacatgcctaatggccatgctcactctagacacactctgatgtggatatgctctctattttgcctacactaaactttcccctccaccctacgtagaagcaagcatgtactttccttttattttatttctttttttccctgctttcatctgaaagagtttttcatgatgacatgacattcagaaattctcaaattttggctcacattcatcttcgttatagttataatttacaaatattcaaagtgaatacattggtatataagtaaatgtctttaaaagcatacttacattgagcatttttgttcattctaatagtcactagttttggggggatttatgtgttttgccacattaactcccttccttaacttgtcccagatccactacctatcattaactgctctgttttctgtcctcgtttttcttgaaccctctgtcttaggtagttttctactgttctgatgagacacaatgatgaagacaacttatgaaataaaacttttatttggatggtagtttatagttctagggctggagactatggctatcatggcataaaatacatcagcaggcaaataggcatgccactatactagtagatagaacttaaatcctaatttcaaattgaagataaggagaaacagcaaacttgtaagagtgagtttggtgtgagctattgaaattccaaagtccatcctcaatataatactgtcaacaatgccacatgttttaatcctttcttacacaattgtactaagtataaacaaagcatacaaataaatgagattctgtagtttattgtcattcaaactatcattttctataccttgcacccataggcttagcaatatcatacagaaaagagcatttaatcatttttcagtcttcataatacttcacagtctccatcctgtttgaaagttcaatcagcaatgttatttaaagggtaagtttttcttacattttattccaatctcttaattgtaattccctgtaaaaaacacaaccaaacattatatttcatgattataatagacaatggtaaagtatatatattatcattctaatgatagaatgaagagaaagtagagtgaggaaacagtgaatcaaaccaaactaaatcccagcaaggcagtctctgtaactgtgtgtacagactgcttggcttgcatttcaggtcttcaaatcctttaagcttttctgaatgccacaaacttctctcttggctttttttctacttcccgtatacaactttacttagtaaacatccagtggtggttttgtctcttggggtctacagcacaatccaggattcacatcatgaatggcttctatggaactccttgcaggagctctcctgccacatcctgacctcagcagtttctcttatctttgagtaaatttcataccccatttactcttgtatcctggactgtaaatctagaaataacttggtaatattgccaattattattctctgtatggaataaaatcttccccctactgaattacttgtgtataaactttgattcatagatgtctttgtttaaaaatccttccttcattttagaagcagaatattccatagatactttcttttcacaagtcacaggatggacaaggggcctctttatgaattggaggtctgaagtgtgagctcttctcctgagaatatcttttcctttatataatttctccttatctcaatcatcacaaaccaaggtttggatatgatatttcttgtttttaaattttctcctttaaatgtgttttttgtattttacttgtcaattaagttcttttatttttcattgtatatactcaaatgtgatcatttctgccaaccatattagtccaaaacacttcacttccaggacctcagtagtcagtgtatccgcaagaggtctcttactcttgacattgggctttttttttaaccaatatgtcttttgaagagtcatcctctcttttaaaaatgtatcaattcaatagaggtatattcatgtaaagaagaaaataatatagaaatccattattcgtataataaaataatcaatgatattttgtattagtgaatacctaagataagtataaaatgacttgcttattgttctgtactaaggatttattatagtgctttgtaaatggctcatacccattttgctactaagttgagtatccctgggccttgttttactgaaacagtgtctaaacctggtccatgctggattttaactgagatttttttgctcctgtacctgagtactgggattagaattacacaccagtgtacccatgtaactttgtctttaataattatgccaaatttatgaatttgacataaagtatacagaatttctctgaatacttaatgaaaaatgctgctcatataacactacttaatttattcttttctttttaaatataattttattcattttcatttcaaataatatccccctttccagttaccaatccaccaaaccctcttttcatccctcatctccccactctactttgcctctatgagggtattcatccacttactaacccactcccacctcaccactctagcaaccccctacactaaggcattaagcctccacaggaccaagggcctccccttccactgatgtcaaataagtccatcctctgctacatatgtatctgaagtgttggattcctacatttatactctttggttggtggtttagtctctgggaactctaggtgttttgattacttgatattattcttcctatatggttgcagtccccttcaactcattcagtccttccactagctctttcattggggtccctgggttgagtccaatggttggttgttagtatctgtatctgtattgctaatgtgtcagtagaaattctcagggaacagtcatatcagacagctgttggcaagtgcttcttggcattatcaatagttttgggtttggtatctgcagatggaatacatctctaggtagagcagcctctggatggccttttctacagtctctgttccattgtttgtccatgtctttccttggacaggaaaattgctagatcaaaaattttgagattggagtgtgtccccatcccctaactgggggccatgcctatctacaggagctgtccactacaggttctagctcctctttgttgtgtatttctactaagtcttccctgttagattgtgagagcttctcacttgtctggcatgtgggattttttactgcctatccccagttccccatcccccactgctacatatttctatgtgattttctgaccctctttacttctttttattccttccaataactgattctgtcccatttttttcctccttcttctctctaacttgcagggcttgacctgcctttgcctcctgtgattattgtgttctcccatctatataagattcaagacaggaattttctgtgtaacagccattggtgaagtgaaacttacttttttgacgagactggcactgaattcacagaaatccaataccccctgcctcttgagtgctggggagaaaggtatgcactaccatacctgcctttaaattgctattttagatgatggctttatgctaattaagtttctgggaaatggaatattatagtcatcagttcatggaaagagcagtaataagggtagtataattaaggaaacattttaatactgcttgtgtgttgaataaatagtatgagtaaggaatatattttgatatcgttcatatgacatgtttttttcttttgtataatgtgaaattttaaatttatgtagcacactggtatagttataataagttgcaaactttatacaaatattttaaactatataaattcagttattgcacatatttcatcattataatctgttgtacatcaacagataacatttggacagcaattgcatatcgaaattagtttgtcattattttgttattgatattactttcacattatttatatcttttttccactggtagtatttttcccaagaattgttcaatgaaaactcttaaaataatgtattccttaatctcttactctttttcttagtagttccttttgttttactccataaactgtagtgaactctcagaataatgaaagaaaagcaacataaaataccttacagggaaataaggagacttgtaactatagtaattctggttgagggctcagtgaagacagtgcataaagggtcagctagcattttttttatttctgttttcatcaattagttctacagaccttactttcacttaattcttcctttgtgtattttatattggtgaattggcatactgtttatttgaagttcctaaatttattaattttgcaaaagttgtactccacgttttgtccataaatgttaaaaatgaaaaaatggacccagtttatactgttcattcattcaatgacttggatgaaattcagtgtttatctggtattttgccagtggtgctccatcattattcatcttagagaatcagaatgtttcccaagagacaggtaaaggaagctacaaacatgatgagcttaggaacttataaaatgtacaaattcacttcacatgaaatgttaaaagtaaaaactatttccataaatatcatatgactctgggtcatatgcccaaatgatattttgcctctatcatgctattatttaaaatttttgctaaatcccaattccaaagacaacccatgacatcatggaaagataatcatattataggactaaatgaatgaggaattaaatgattttaggatataaattatttcttttttacccctgagttctataggactcctcatttaaacttaacctacacctaaactctctcactaatggtagattttatttgttgttggcatgtttacaaatgtgtaaaattaaatgggtgtccctcttgcttacatttgtcaactaaaaaatctctttctctctctccgatagagaaatagagtgctatccttgtagcacaaatagaaacattcatccatattaatgaggaaaatacttgagtgttgaagcatactgtcatagccctctgttgctctaaccacagtcaattttaatgtcatgaaccattctgattttggcatatcagtcaacagtgtgcctgttaggagacaatgaccaggggaaataacaaaaattatatgttacatagttaaaactgctcccggtgtattctgatgcgtttgcattcttgataaactattaagtacaacatttatagaaaaccacagggaatattccctggaatataccatatctgcattcttccaggaaggacctaacttccctcagtggattataaaatcatattcatcgctgataaagttaagtaaggttaaaaactctgtttattggcacagagactatattcagtatccagaatgacctcttctgcaagaaatagtttgcagggacttttatagtcagcgatagtggtgcatatcaatacattgcacaaacactttgaaatgagtttatttagggatggtagtgaaagtctatttgtctcaacaatatatttcagtaagctaacaaactcgataaaaattataaaataaaatcctattttctaaaataactatgaaagcagaaaacaaaacttgctttttacctagaacatataaaacattctttctctttacccatagacagaatgttctccataagaaatcagaagtctagagtatatttaataaatttcttagtttcacaaatgtttcattaataaatgagtgaatttgaaaaatataaacatctaagcaaaaatatacaaatatatggaaactatgtatagtattacttctctcaatgtagaagtttattgtgagcagatatgtaaatgatagaaaaagggaagtttgattaacagaaatgcaagtaaaatcatatatagaatataagggcattgacatcacaatattggctattgaaaatatactgagttctatagtagcggcctcacggagagttgtacttttctcgtatctgacagagcatttaacaaaagggggggctggtaagatggctcatcaggtaagagcactggactgctcttctgaaggtcctgagttcaaatcccagcaaccacatggtggctcacaaccatccgtaacaagatctgactccctcttctggtgtgtctgaagacagctacagtgtacttacatataataaatactttaaaatctttaaaaaacaaacaaacaaaaaaccaaaaagggatggtataattaaatctatttattgaattaatggatcaatagtttggttgactaagttaaggtgacaagcagatttgtagaaagctgcttttgtcagtctcctttacttatgacctttgtgactttcaactagagaaattccatagatacaactatgatacttaacttcttaagacacaatgtctacttcagaccaattagaagtatacttcaaaaaatgccatatgtttatagatagattcattttgtttatgttctgtatacagaatcttacttctgtatgataatattgtcattatcattatatattgaggtattgccatgtgccatgtgtacaatattttcatacagtatctgttatcgttcccacctacatgtatttatgtatatcaatacatagtacagacccatttaactgagtgctcaagaatgagatagatatttggagattggcatgcattatgacatatatttgaatggtcttcattacaatggaaattacaagcttatttttgtattgctaatttttcctctccattttaaccccttctttagatgcattagtacttatatggttataaattgtttctacattctagtcagtgacaatatgacataccaaaaagtactaaaaatatacaatctgattttattatattcagggaagaaaatactggattaaaaataattaagttagtactattttctgagatgaaatttctttcatcttctacatatggctttcaatatcactctaccatataattttattacatacatacaattatatttcaattagatttccttgctaaaattttaagattgatagagacaagacaagtaactaacaattaccacatattactccagtttcaaacttgtttaaattataattttctacgttatttatgtttgtctctgtggtaaaagaggatgatctatgtcagacattgtcaacattaaaagatatgttgtgaaaaatgcactagaacaacctatgtagtttcaaatgtattccatatatgtttataaggagacacaaaaatgacagtaaagagattctaagagagtagaagaaaaattctagtttagggttgtatctgagtagtctttccagaagatttttggtgaaactacaaaattttggacatgaatttcaagaccattgcctatttcatggatcaagatagtgatctctctcgctctcccactcttactgtctgtctgtctctctgtgcatgtgtgtgttaagtttttttttttttttggttgtgtgtgtgtgtgtgtgtgtgtgtgtgatgacaccttttgtcctcacatgtaccatttaatagacagagaatatgcaatagcagtaatgattctggaggtcacacacctttaggaaacaaatcagatgatatgaaatattgtgataggggtttgttacctgcatttcaaggaggatccagaaatatatccattaaaccaaatatcacatctgtcttcaacatttcattgttacatttacatttgtagtattttgaacaatttcctattttttgaaatcagaggaacatttcttaacccatctgtggctttgtacactgcagacagtatcatgaattaacccttctttctgggctttcagtaaattatgaactaaagtgacataaggaaagaataaaacaatattgaattgcctttaaatgaatacagtttcagttcttaatcctatgactatttttttttacctttagagttatccaaagacatttttagagcagaaatcaatcagataaaatgagttgctattagatattgtaccaaaggaaggcagatgttcatgaagaaataacttttggtctgggttatacgtagtaactgatagaaatttattttataataaaataactgtctgagtttgtcaagtaatatagcttacttttcaaactagtgatcttcacatcaaagagttcacacaaaaacaaaatgagttatactcataatttcagtgaaaattagacatattcaagatgatagcctcaaatttatagttctttcaagttgtatgttttacatatattatttacctttaatccagcaattttcttagtttgatggtccctgaaactctctctttccaaagacaacatacttcttaaaatttctaagttgtaaatatctgttaattatttaagattgctcatgcttctttcatcaaaatattagttgattattaatccatagaaatcttttttatagacaagttaataatattcaataaagtacactctatcaagattagatagcatttgttctgaagtgtctctttcagattgaactttgtaaaagccatttagtgtacgactggggaaggatatatttagacatcttgctattagagataaaatggctgaatcaactgtaatgcttgacttagaacaattagcagtctagaatcacaattgataatcataaactcatagaattactttgtattacctcaaacaatggcatttaatttactggaagtcagtatatattcaagacactctctctcatgtcagctgtctttgaagccataggctcaaatgattctcctgcatcagcttccttagtagctaggaacacatacaattatctcactgtatttgtttggccatagcaactctgattattctatgaatttgagcttataacttttatttttttaaaaaactgaaaaattattgtaagtaggtttatattcgtatcttatggtgaaacaactttcaacctttaaatacaatattagtaaaattgtggtgtccaatactaaagatttgtttaaacaaaaaaaaaattctagatatttttctcctggttgagttgaaaatctccaataaaactttagtttattcctcaagtatattaaagaagttatatgttttaactctattgcagaaggtgcttatcaaatctgtttacaaatattcagtatttcctactatttaagttacttttactgtatgaccttttctctttaaatgcctttgtgctggtaacacacgcaaattacagcataagcagaataagcacatagaatataatattggttaatcccatacagcaaaattgactatgagcattagccaatatttctttgctatttacaatttcattttataattcaactgaatttttttagtgtcagtgttttaacagcagatttctcccaggaactctttgaaaactatgatgccaattacttttattttgtaataaactgtaggaaactctataaagatttaggcaataatgtaggttgacagtaagaactgaaagctaggataatttttttagaattctttagattatgctgaagtttacttttttatcaatgtttatttttataataaccacgtttttagacatatttagaacgttctttaattaacaaatcatccttgtgtgtttgcatatgtgtaaacatgtatgcatgtatgtgtacatgaaggagagaggtaaatgttaaatatttatctccatcataatttaccttgttttttttaagacagagtctctctctgaacttagtgttcacagtttcagctagcctggctaaccagtgaacctctgggatcctcttgtctctacatccttaggttgtatttacaggcttgtttcaccatacttgtctttacatgattcttggagaggatacctctggtactcctatttatgcaagaagcactttacctatggagttatatttctaattccaatgatcactaactgatacttccagatcaatagtccagctagtccaaacaaaatcaaggtcaatctggcttcatgctcagaattcaatgcctctaatgagtatacaggaacatagtaccatactccttatggtttatttcagtagtaaactctaccgcatcaaaattaagactgaaacatctgtcaatttgtagactgttccttttgaaatgtagaactatttgtatgttttccctttgaaatattcccttatatattctactacattcatagatttgaagcatatctgaacatctttggataattttgaggtttttgtacatagaaagaaggaggagacaatattccatctttggatatatatccagtttccagatcaccaatgattgaatagattcttctttctccaatatgtgttcctggtactttgtaaaaccaattgcttataaatattttgaaggttttgtacatatttccattctgtttcttttcttctgtggtcaggtcttctagaaatacgatgcttgatttatgtagctttagtatatattgggaagtgaggatttatgaaatgtttagatttatacttttagctcatgcttgctttgtctaattgaatcttttgtggttatgtgaattttctgattttttctattaaaataaaggttgtaattagtattttattgcaggtttcagtgaatctatagattgttatggggaaagaatatatattaactgtgcttttccaactcatgaacatgaggaaacttttcatgcttgagaattctatgtgaatttttcaaattatatagcttaatttagaaatatttaactttattgactaatttttgagtatttttgcgacatatatatatatatatactccattttctatgtgtaaaatgttatttttatataattagctcacaaagaaacacatgacttcatagcatttttcaaacactattttgtttgattcttccattcattttctctctttatccctcctttcagtactttattgatttgcttcaaatattggcctttctctttaatgtctcacatgtctaatattttttatatgttatggcttattctcttcctagatcttatattccctttcgtagtttttggtccttaaggaacattaattacacacacacacacatgtatatatatataaatatatatatatatatatatatatatatatatatatatatatatatatatatatctcaattagcatcaaggatcttcatttgagaaataatataaagtaaaggattttttagcctgactttttattttacaacttcactgaattagtgaggaaacaacctctaaattggaggacaatttttttttcaaaatgttaatctaacaaagcattaatatacacaatacacagaagacacaaacaaaaatcctcctcaacaacaaaagaatattctttactaaaatggacaaaagacactgctcataagtcattacaaaaataaatatttaaaaaatttttatttattttttatttgtcttttatttttctctttttttattaggtattttcctcgtttacatttccaatgctatcccaaaagtcccccatacccaccccctcaatcccttatgcacccactccccctttttggccctggcgttcccctgtactggggcatataaagtttgcaagtccaaagggcctctctttccagtgatggctgactaggccatcttttgatacatatgaagctagagacaagagctccggagtactggttagttcatattgttgttccacctatagggttgcagttccctttagctccttgggtactttctctagctcctccattgggggtcttgtgacccatccaatagctgactgtgatcatccacttctgtgtttgctaggccccggcatattctcacaagagacagctatatctgggtcctttcagcaaaattgtgctagtgtatgcaatggtgtcagcgtttggaagctgattatgggatggatccctgcatatggcaatcactagatggtccatccttttgtcacagctccaaattttgtctctgtaactcctttcatgggtgttttgttcccatttctaagaaggggcaaagtgtccacaatttggtcttcattcttcttgagtttcatgtgttttgcaaattgtatcttatatcttgggtatcctaagtttctgggctaatgtccacttatcagtgagtacatattgtgtgagttcctttgtgattgggttacctcactcaggatgatgccctccaggtccatccatttggctaggaatttcataaactcattctttttaatagctgagtagtactccattgtgtaaatgtaccacattttctgtatccattcctctgttgaggggcatctgggttctttccagcttctggctattataaataaggctgctatgaacatagtggagcatgtgtccttcttaccggttgggacatcttctggatatatgcccaggagaggtattgcgggatcctctggtagtactatgtccaattttctgaaaaactgccagattgatttccagagtggttgtacaagtttgcaatcccaccaacaatggaggagtgttcctctttctccacatcctcgccagcatctgctgtcacctgaatttttgatcttagccattctgacttgtgtgaggtggaatctcagggttgttttgatttgcatttccctgatgattaaggatgttgaacatttattcaggtgcttctcagccattcggtattcctcaggtgagaattctttgttcagctctgagccccattttttaatggggttatttgattttctggagtccaccttcttgagttctttatatatattggatattagtcccctatccgatttgggataggtaaagatcctttcccaatctgttggtggtctttttgttttattgacggtttaaaacccctaacttgggcaaaagaaaatgtaacccaaaatccaagtgtgatatggcttagtcaagttaaaattatacacctattcaagctcatgaaaaaccacttctcagcatggggagcaagtacaagcatgaaattcaaacctttatgtaaaaaatcattgccaattgatagacaatgtcaaaagaagagtcacttttatttaatgatatgacccctggtagatcaatcattcttcagtggtaagttacatatacacatcagtatgggcagcagagattggacctgaaatactgaaaaaaaaggagaatataaagttggattattagggacggggagtgtatatgtcagtacttggtaggtaggggtaaatataatcaaaatacatttcatgaaattcccaaagaactaataagaactaataagataaaatattttttgcagatcagaatgcattgtttattaatatgtttacagtagaaaataatgagatgaatgccactaagtgaagacattatgaaatatttgtgaaaacaggatattattagtgactttttctttactctgcctgttatgtaaaacaacataaaaagagtaattagaactaacattgaggattatattaggtttcctaatgttaaaagtttaaagatagaaacattgttgtattgccttctagagacaataaagtataaaataataaaatcagaactttcctaacataaattcttgagaaaactcattctttttcatgaaaaccatgaatagtctttgacattttgcgattgaacattgagccattctgctaccatagcatagcatgagtattgtgacatgtctatttgatttttctgggaaatgactttcaaaagcacagcaaacaaagcagtcataaaactcatgtatgtgccctccacttggacctcaggacagatggttgtgtcatttattagtcattcttacttcagaggaattccacagcatagcaaaatgaaagaaaaactccaaagaaagggaaaatagaggttttcctttgtggtataattttatgattctttagctaatggaattcaagaaaaccaaaactgtgcaacccacattttctctgttaatgaaaatctgagggagattacacacacacacacacacacacacacacacacacacacacacctaacaagctaatttctttatatactaaattaagtcctgtattaagttcttatataggcttctagtttgtcctatgggtgtataaaccctattcaactgtgacttataaaagatatctacacatagatagtttttccttggccaggaatgttagctgaatggtacagccctggcctagtatgcaaaaaggcccttggtttgatgttctgtatcacacagacagacatagacacacacatacacacagagagacactgaaacaaaggaaagaataaaatagcaaagaaagaaaagaaatagaattggcttggaacatacttcagttggaaaagtacttgtccaaatgtaaagagtactgtttgttccccagcacccacatcaggagccagacaagatggtggacattgtgtttccaattctgggaaattataagcaccaggatactggagcttctatcgaaccttcctagtctaatcagagatccagttcactggacgaaactaggtgctgcatccctcagaaacaacacttttggtttccacatgtatacatgcacacatgtatgtaatttcacatacacaaaaagcagcagcagaacaacaatggcagcaagaaacagcttttcctttcaggttctttgtccactcaggagttttggcttactcttgcagtcatctgtttctcctgcagtcttgctgtggtgttgtgccgataactttcctgggtctttactaggacctgcctgtttctacagtcacctgaaatacctcatgtttcccttaagtaccaaagaaaatgccaagtgctaactgtttagtgctctaagttttttttttttttttttcatttgattatctgggtcctagccatgttctctaatgcaagggattttgtgctgttcgattagctttccttcattgctaacgacacttactagttttcagagactagggtgttccttccaaatacataattggacacaattgaaagagatggtcacaaacattatgcagatttttgtgtaaaaagattcttttaggatttggtataattaatagaaatattgtgttgctatggaagtggatagatatcaaagttgttcacaaagtgaatgaatgagaatgattcagacaatgatctgctgcccagaatctaatcctttccaacatattagccaacagtactaagaaacgggaataaaggatgctcagaaaaatcctccagtttgcatattacaatgttttacagccaagaatcacagtaattgtctttgttttgttttgttttgatatcatagaacttgctcataagtattgcaaattattgattaattttatgggttttgctttaaaattcattacaaattttaaatgaaacccaccagtatctatcatgcctaacttttcatcctattccctagtcttcctatcagacttcatccttgtgttcatttatggctgactaaaccagccatctccattggttgctaatctgcatagaccaggggcagcacttctcattcatgtgagcagaatccacttatcccaggactgtattaagaagttactaaaggaattttatttgtttggtagaaaccatggtgaatgaatcatgaggatcaatttgactcaccaaaaatagttgttattattattattattatttcttcttcttcttcttcttcttcttcttcttcttcttcttcttcttcttcttcttcttcttcttcttcttcttcttcttcttcttcttcttcttgtcttcttcttgtcttctcgtcttcttcttcttcttcttcttcttctcctcctcctcctcctcctcctcctcctcctcctcctcctcctcctcctcctcttcttcttcttcttcttcttcttcttcttcttcttcttcttcttcttcttcttcttcctcctcttcttcctcttcctccacttctcctcctccttcaccttcctcctcctcgtcttcttcctcttcttccttctcttcctcttattataattattaaataaaatatgggtttctttctgcttttctttttattggatacttatttacatttcaatttatccagtttcctggtcccccaactcccctatgccgtcttacctcctccttcttttatgagggtgttctcccatccaaccacccactcctgccttccactatactagggcattaagccttcataggaccaagggcctcttctcccattgatgtcttacaaggcaatcctctgctacatatgtgactggaaccataagtccctccatgtgtacccttttgttggtgatttagtctctgggagctctgggggcatctggttggtagatattttgttcttcctatggggtttttaacaccttagccccttcagtcctttccttatttcctccactggggtccccatgctcagtccaatagcatccatacctgaattggacaggctccgtcagagcttcccaggagacagttatatcagacacttcatggcatcagcagtagcttctgggttttctgtctgcttatggcaaggatgcccccaatggaacagtatctggattgcctttcctccagtctctgcttcactctttgtccctgcattttctttaaacaagtacaattctgggagaaaatttgggagagggatgccatgcctatcctctatatttggcatttctacaggttttcccttccatttgttaggtatctcagctaaggtcatcgctcttgactcctgggaaactcttgcttccctggtatttggggctttatggtggattttgtatcatccacataaatattttctgtttggatcaagaaattaaaactattcctttcatgcacacacatccttcttctccttctcccccttgtgttccttgttctcttcctcctccttctcttcctcatcatccttctcttccttctccccatcttcatgatcattatcagacgaaatgtgaatagtaatgtagtgaatcacatgcaagatttaaaagaaaataaaatatttcctttttgataaaagcacttaaaatatttttttcatattagaagacaaaataagttcagtatactggaagaacaatggaaacatatttgaatttaactcagtaagactatctgtatctcattgttaacccacagagaacttgagacaaagaatatacaggctccatgatgtagccacactcaaacttgcagtcttagactgacattaaaaagatcactctgttaagattatttgatagtaaactttgtaaatcttacctaaacaatttttggacaacacaaacagaatttttagtcaatgtggtaatgaagcaaaattctgcaacatatattaactcttctttatgacagtattttttatatgtgggctcaaggtactataaggctaatggtaaaataagaatttttgtgtgttgacacagcaaagtgagaatttagaggaaaaaatcaaaggatctttgatatttttatgaataagtttatgaatgtgatctctctccccctccctccctcccctcccctccccttctctcttctctctctctctctctctctctctctctctctctctctctctctctctctctctctctctctctccagaaacttgatgatttttttgaatcagaataaacaaagatattcaaaaccaaaaccaaaacaggtgattccttctggtatgaaagtagagggtatcccagcagaagtattaacaatgatttttttgttagaatcttgaaagaaaatatgcatccctctatcctatgccatttcctgtatggcatttcaaatcaaatatcccattctgcgtagtccatcatctgggttctacttgtagcctaactttgtttattctgttcattccttttttttctttcatagttttagccatattcctcaaccgtttcaaccctataacatgagagagaaaagaaaaatagatagagctggcaggatggaatgtttatcttagaatacttcttattaattacaccatcaagtttatggtttaagtttgatctacactgttaggatatctaatttctcctatttgattcttcttcaccaattactacttaaaaactgcaccaatagcaatcatctaacaaccaatggcataccatccacaagaaaccaccctcaggttggagagatggctcagcagttaagagtactgactgctcttctgaaaggtcccaagttcaattcccaggaactatgtggtggctcacaaccatctgtaatgggatctgatgcattcttctgttgtgtgtctaaagacaactagagtgtacttgtataaatagtaacaaataaataatattttctttaaaaaaaagcctctcaggtccatagcattcatatatactcagaaaactccccaaattccacagtcacataattacaaatactgtttgcagcttgcaaaatcatgaccctactacagcagaaggcaaatcacatgcatttgctgtattcagtcttaagtatcccaatactccatatctgagaataaaatgaaaacacattcccatattattttgtctttttatatattcttacattattttgatgtttattagatattaactttatttacatttcaaatattgttggattttttttaatgaaaccaaaaatttcactagagagaactactgcttcatcttgttatctgatatacacatgtatatggtgacatgggcacctctttccaaacataaacattaaaagagtttagttaaagattatattcacctgcaaaaatttctgtgtatggccagcacattattcttagtcaaaatatctcagaatatcaaaattcaaaacccaaacaaagatcttaaagaaatccaataattccagctcctctaacaggtacaaactttaaccatccaattcctgttcaaaatactatgaatctcattttaaaaactattaatttcagttcgtcattacagatagaaatcaggaaaaaaaatgcttgcaagtggatatgtcaagaataaatatctggaataaagaaggtattaataacactaagaccaaaatataaatgaaagaattgtcaatgatgtattttaaacaactgtgatgaacatgattaggagtcagaattgaaaaggagaaaatattcttaaatacatgagttacatacatatagaaatgggaattttgataattaaaaatcaaaactagaaatattaaaccctgccagtgaaaggaaggtactaaataccaacattttccctcaaagatcaaggtacctaaacccaagaatggacatttacagagtattacccatatgtagtcataaattggcaaatttagatgctggaagagagatagttccttttctttagagatgctgtcctgaaagaatacctgtattggagtggttccttactctgtgaatgtataggcagcatgaagaagataggagatagtacattggaaagaaaagaacatgtggagattggaaggaattggaggtacaactagaaagtgtagaactgagtgggggtatattcaaataaaattacatgtgtttatgaaacagtcagctttagaaagacacaagggaacaaaacacccaaggaaggagttacagagacaaagtttggagctgagacgaaaggatgaaccatcaaaagactgtcatacccggggatccatcccataatcagcctccaaatgctgacacattgcatacactagcaggtttttgctgaaaggacccagatatggctgtctcttgtgagactatgccagggcctaacaaacacagaagtggatgctcacagttagctattggatggatcacagggcccccaatggaggagctagagaaagtgaccaaggagctaaagggatctgcaaccttataggtgcaacaacaatatgaactaaccagcccccccccccccaagctcgtgtctctacctacctagtcggccatcagtggagagagcccccttggtcgtgcaaactttatatgcctcagtacaggggaatgccagggccaaagagtgggagtgggtggttgggggagtgggtgggggagtgtatgggggacttttgggatagcattggaaatgtaaataaaataaatacctaataaataaaaaaagaaagacacaaatcataaagtattacaccaaaactgcatttaccattgtggggtaaacaaggtagacacacttatataaccaatttctgtcacttaaactactgaaattttttactttattgttatttaataaattctgaaatttagacaaattgaaaaggagaaaatattcttgaatacatgagttatatacatatagagatggaaattttgataattaaaaatcaaaactagaaatattaaaccctgccagtgaaaggaaggtactaaataccagcattttccctcaaagatcaagatgataacaaagtatcaaaataagttcactaatatgtataaaatgtctaactgcaaactgtagcttattctaggtaaaaatacttatcaccatttaaattatatcaacctatggtggggagaatagcaaaaaaaatattactaggttaaaaagagtatctgatgaaatctaatatttattagaaatataaagttagcaaataaatattttaaggcagtgttctccacttgataaaatagctacatagacaatatcctgatcacatcaaacataaaacctaggacactatagcaacttaacaaaaagggacaaaatagtatttctgatatttctttccaacatgtctttggaagtttaatgtagttcatgggttgagacagagaagtacggtttacaaattataatgaaagaaataaaactgtcctgcattgggtgaaatgactgcctttgataaagcactgaaatgaacttatgaaaaaaaaaagtcttcagagctagttactgaatgcatcaagacttaactatatgagcatcattcattttcattgttgtgttaatactaaaagtagcaatttaagagttttttgtaatgtgtttttgtgtgcttatgtgtgtgaatgtgcatgtgcgtgtgcgtgcgtgcgtgcgtgcgtgcgtgcgtgcgtgtgtgtgtgttgtggttgtgccacaacaaagattcagaggacaacttatggtggactttcccttgtaatatttggaatctgaagatcaaacttatgccatgaggcttggcaaaagtgtctctacctgctaatgtatcttatttgctcaaatgaacaccaatttaatttgtaaaatatttttgaaagctttgagactcagtcagtgtttagtcatctcttgttgtgagcttgtggggaagtaaaacaacatgttataaatggcctggtagaatatagcaccttgtatcatggctaggaaatagagaaatataagaagagaccaggtcatgctcctagtgacaaaactgtccatattagacccacctccaaatattactatcatatcatctttgatatcttattgaggagttactccactgattacataagagcacccaagatttattaacttctcagaagtctataatctgtaaaacaggactctaaattgaacacttcaggagtatatcagacttaaatggtaagatcagattattatacatatactagctgtttccttgcatgcaagtcatggattaatacaatgcagaaaatatttaaactagaaagaaactctagaataaaatataagtaatgaggtacaggatccatttttctctatacataaaaatataatgctcttgtgaaatgaattaaaagtctaaatgtgtatgtcagtattaatgaatttaaagagtcaatattatctatatgtatattgttcttgactcagtgttttcctatttaaaacaaaattccagcattgactgattaatttcaaagtttatatgaaaagacaaaagatctatcatagacagaaaaaaatactaaagtagatcacaagtttgtaaatgatttataagactttgctttcaccttttaattaaaacaatgtagaaatctaagtaatttagcactggcaaatatcataaatataatacagagcacatgggcccagaagtagaaagtgcatatctagtgactgaaggataggttttcaggtgatggtgatatacttaggcaaggtaatataactgtaatgcagtcattcaagaggtaaacactcctttgtgagtgagacaagtgaccataggtgtgtgggttcatttctggttcttcaattctgttccattgatcttcctggctgtctctgtacaaataccatgcagtattcctcagtaatagagcttgaggtcagggatagaacttccaccagaagttcttttattgttttgaatagtttttgctatcctggttttttttttattattccaaataaatttgcaaattgtgctttctaagtctattgagttggaattttgataggtattggactgaatcttgtataacacatctttcacttgcttggttagagtctcaccaaggaattttatgttatttgtgactactgtgaaggctgccatttccataatttctttcttagagtgtttatcatttcagtagaggaagcatactgatttgtttgagttaatatatttagccactttcatgaagttgtgtttcaggataaggagttctctggtggaatttttgtggtcacttaactacactatcatatcatctgcaaatagcaatattttgacttcttgaaaggatttgtaccccactgctgattgtgagggcatagagctatacagaattgaagcctgggaaaatgaaacacaaaggttttcagtgctgttagaggtactttaaaatgtgttttcagattggatctattgtaaaaagcataccattttttcagctcttttctgatcatttccagggcattctttgaaagaaattctaatgttagtcagagatattacatattcatgtttcctgttacactattcataacaccaaatatctagcagtagactagatattcatctactgaaatcataggaagaaaattttatttataagcatttgctaataactaagctataagattaaaattatgcaatatggggagttgatttaattgaaattggacagacacaatttcttaaaaacaaaaccatgtatacttaaaacaaaaggcatttgttacatctcatgagcacatataatctttctcatggtaaatattgatgattgctctaaccaaacaagagaaagatttgtatgacaagaacattaagtctctgaggaaagaaacaaagaagatctcagaagatgaacagatctcccatgatcatggattggcagaattaatattgttaaaatggccatgttaaaatacgttttcaatccaaaaaaaataggagaggaacaatgagaaagaacgaaagtaaatgagaagtaaacagagatgatataatacatgtttcataagataagcagactaaagacttctgcatgtgaaatagaaaagtgccatagatctgcattttaagaaatgattctatgtattttgaatacttttaaatgaacatgacatgttacagggcttctctaaatagtgcctgagaatttttttaaaaatcattttctttctataacaggcataagaaattcatcatactcataccaatctacacaagagtgagatcatggtaccacctacatattcatctataataaaaccaagaaaataagaaaatactttatatataaatatttgtttttatgaagccataaaacctaactatataatttgggggaaaaaaacttacatggaattgacgacacagaggaaaataatccagactcaaaaaaaaaaaaaaaaaaaaaaaaaaaaaaaccaccaccaccaccaccaccacaacaacaacaaaaagacacatttgatctctaatcatatcattgaattgaagtgtgtttgtcactggtttctgaactgaagaaaaaacaagagccatgaatatagacagtaaatatctgtttcagaaagtgaagagcttattcttgtttgtttgttttgttttgttttatcaaaacagggtttttctgtatagcactggctgtcctggaactcactttgtagaccaggctggcctcaaactcagaaatccgcctgcctctgcctcccaagtgctgggattaaaggtgtgtgccactgccgcccatcgaataacatattcataattacccataaaaatggcaaagaaaaaccgggctgggagatgagggagaggaacatggtgtcaagaattcaaacaaacgtggtattgctgaatatgatattactgtagcctaatataggatgctgaataaaacacattttagaaagaatgcttggcatttccaagcactaacaatattttcattttatgtgaaggaaattgtaaatcaagtgtttattagttattagtagtagtcatctcataatacagcaatttgatatttctgataattctttacaaacaaatgacaattgtttcactctggatctgatttagtaactctgtgtagagaatctttttaatttttattgccaagcagacaagttttctgaggttattcctgtctgtggaaatatttatgtgttgagagagggtttggctgtatggatgattacaacagtttgataatgctaagtgactcatgcaaatagaaatttgagttccaaaaagaaagtgttctgataagatcaatgaatatttatgagcctgggtatctcttatttttattcgtatcatataacagtgttgactggctttaaaatcttagtttttgagaaatgggtatcctcactatggcccaaatatgccctaatacttgctatatttcttttagttaatgaacactgtaaagaaattgcacagtgcacaaaaggaaataacaggtaaatgcagatgtcaaaaggatgaaacaaaaaatgtataaattctgaaaaatgcacttgcatgttcaatagcactgtctacaaaatatagcgttgtctgttgacagtgacaaagtgtaaggagcagatagtagggccctgtaccttaatacttaatattttctagaatcgtgtctttcattttttgctttgttttccatcaatatctggctacttaatgtggtgtgaggagcctttctactatattaatgtatgcttgccttgttgaaattcaagaaaagaagcatatcagtggatacgaatgaccattttgcatgaaaactatgcatgaaagattttataatatgctgaaaatatcaaaacatcacacacatcttaatttcttcataaaatatatttatattaggattattgtaattaaatctttattaatctttaactgttatttgtggtgtgtgcttcattttcattgaagtatgtgttattatttgcaggctcagtacattcattcagctttttgactggacatatttagaatccccaacctacttcaaacagtcaccttaatctgacacatgacatagatatacaaagaactaagtaacaaattgagcaagcaaattcacaaggaacataaataatgaagcagacataccaacattttcacctaagtatatcccagagctacatgcattctctttcaaatattaccagataatcaaagttttttttttttttttttttttttagtatagaatagagtttatttagggcatggggtggggagttaagacggtactagacatagaaaaagacatagatatatagagagtagagaagtagaagaatagaggccagcaatgagcatgtgaagagagaggtgggaagggaacggggagagaggagggaagggatgaggggacagagtgggagcaagaaaacaagagagaaaacaagcaaggagagatccagcagcccctccagatcatcaaaattaaataaaaactaatacgcttcatattttccttgaggaagtgataatacaatggttttacgacccttgatatgaagcatagaattaactcgtacataaagtaaaaatgatgcaagtgaaatagaagagggtatatttttcaagttgcgtagtggtgtacaatagtctcaataggaatttgtcaagaaatgcaaggaattaaagacaacagttcacatataattcttatgtaaatttctgggaaacaaatatggctcatggaagatgatgccagaggacatggactcctatttgagtttgaaagtgaatctttgatttcataattcataccataatgaaattgaaggtcatataagaatcacacactgacacaataaatatagaatgtattattactgaaggaaccagagagataaatgagaacagtttaatatttaacaaagaatatcatggttatggaaaggtatcaactcttttgcctactctattgactatgacgacaggaaaaaattttaaagggacacatctgatacacaatctctacttgaatgcaacttctatgatcttctctaagatagtaccttggtatcttctagtactatttaaagtctttgaataactgttttgtataaaattacattctttagaaaaaaagaacctttgcaagaaattcactgtagtgaaataaattcagcaaactttgttgatcataaaacatttctgtggattattattcaatattactggatattattcagtattcactttactgtccaactcaaatgttcagcttttatcatctttgttcttgtcattaaggagttcaaacaataaacttatagaaccactatttcttttttccttaagatccaacaattttttttttttattttttggcttttcgagtcaaggtttctctgtgtagccctggctgtcctggaactcactctgtagaccaggctggccttgaactcagaaatttgcctgcctctgcctcccaaatgctgggactaaaggggtgcaccaccatgcctggctaatttttattttctatactgccaagtcctgaactcaagtgatcagaggaacatcaaatatgtgtccatgatgtggtatctaaaacacagataaataatgataggcattcgtcctgagttccaaagccatgcatttcaaaatggtaccactgtgttttccctcctgcataattaccatgccactcgacttgtgttctctaactattttctagattttaaaaaagtatttcttcctataatttgagatgagaaattctctttgtgctatgatgcacctaaccctcaagagatttgaggccccagggagtggggaggtctggttgggtcaaagttatggacaacctcttggagacaggaactgtctgagggcagactgtgagggggataacaactgtactgtaaaagtgtttgatgatgatgatgatgatgatgatgatgatgatgatacagaaattagttaaaaaaaagagtaaaatgacttccagaataaaaaaaaaagtgaagttttatatacattttttccatttataaatccctgaaactgcaacagtgtaatttcaggaaaacaatttcaggaattgataatacagagacaggcaatctaaattcaaaaataaaaataaaattactggttatgtttttctttatttgagcttattaggtgtacttagatgtattgatatagtctcacctctggtttcagtctagaaagaacaggaacaacacattgaatgatgatcaggaaacatatgtttctgaattgatttcagtattggtaattggagaatgaaataaaaataaataaaactgagtaagtggtggagaaagggatcatgtaaagtaggaatgtataaaaacaaaagtattgatgagtatgaatctattaaacttaccaacttaagctgctaattaaaagaaagcttaaaatgaaacaatgatatttgcgattaatgacaatatttttaaattatatcaagaaaaatagattttagaacaaaactttaatacagttaaatcttcttttttctttttttttatttgtgattgtctcacgatagagtatttttgataccttatttacatttgattaggataaatgtataaaagacaatgtattcatgatgactcttattgaattcttttattcatatactgggaaacatatcttctatacaaccatgtgtttctattttacagctgaggtgacaaggttttatttttttttccattttttattaggtatttaactcatttacatttccaatgctataccaaaagtcccccatatccacccacccccactcccctgcccacccactccccctttttggccctggaattcccctgtactggggcatataaagtttgcaagtccaatgggcctctctttccagtgatggccgactaggccatcttttgatatatatgcagctagagtcaagagctccagggtactggttagctcataatgttgttccacctatagggttgcagatccctttagctccttggctactttctctagctcctccattgggagccctatgatccatccattagctgactgtgagcatccacttctgtgttgtgacaaggttttatatggtggtaaaatatttatgcgttgaaagaggacttatctatatcaataaagaaaacaactgttttaggggtctgcacaactttcaaatggcaaactcattttcagatagaaagttctccaataataatagtgcagtttttagagtctggttgtactttttattgttcattgatgacacataacaataaagattgactttagaatcctatattttgagaaaataggcaatattacaatgtctcagaggtgacctaatacttgctttgttaatttatattgatcatttccataattaatagtatagtgtaaacatataattaaatgtgtcacaaatgcagaccttaaaaggatagataaaaatgggatgaaatcccaggaaaaaatatttactaggtcactaacattgttacccaaaagtggatttgctatgaagctgaaggtacataacaaatggtagatttccaagccttgctccagaaggatatttaaagactgtatttcttcttcttcctcctcttcttcttcttcttcttcttcttcttcttcttcttcttcttcttcttcttcttcttcttcttcttcttcttcttcttcttcttcttcttccccttcctcctcgtcctcctcctcctcctcctcctcctcctcctcctccttcttcttcttttttaatctcaaggcttttatcaatggttttctatgtaggcagtgtgagaaaaaaaatttctctatataaggacaattggcttcctttgtttgggaaggaatggattctgatcgctatctttttgtccatcatagctgacctatacagctctcaaaatttgaacaatttctcaacctctttttcgtatgtccatgtcttcttcagataatatttttaagttagtcattgtcataaaagttatttctgtcttgaaccatcattttttgtattacacattcattgtattacattatttttgtaagtttagtgtattttttgtcaattttcatagttaaacctagaaattgcaacctaattgtgacaaattcttgaacttgacttaaaatttagagaaatatattcctgaaaataaactatataaacagatgcacaaattttcttaaataatcaaaatttcaaactagatatgccttcccttcataatattctaggaatatcaatgttcagctgaaacaaacaaattgctgaatagtcccttagtgagaaaccaaaggaatgttttaagaattttgaaaggaagtatagactgatcacatgcccaaagcaaagtttcatgcaagataaacacaatactttttccaacgttaagtatatctaggaaagtgatgtacaataagaaattgtcaagagttcaagatcttaactcagttatcactccttgtatataaaataccttcatttttgacatatccaagtgagttaaataatatgaagcaacatttttaccttctcatagaaatattataatgccagaaaaccctaaatcccatcaattcataaagttgggaatttgttttatcctataacataatgcaaatacttgattatgaggttagataaacccacataataaccttagtatgtgatatacctcaagttaaccacatacacaacacagaaaaaaatcaatgtgttccaaataacatgtcttatgacaattggctgtattatattttaagtatatccctcatatcattgatttctgttgaatttatatcagtaaaatgtgttgatttttctacattaaattagtgtagcatatttttttgaaagtttccttatctggagtattacatttactgtttttcatatactaaacattttcatctcttgtatgatgaacacactggatggggataaatgatatttttatctgttcatggattcagtttataggtacttaattgatcacatttatatcaatgttcatgaagaaaattcatctgcaagtatgttatttttcagttccttatatggttcagatatcaaggtaaccatggccttatgaaaagaatatggatatataacttctctttctattttatgggaagtatgaggagaattagtattaactttctttgaacatttgggaggatgtgtactaaatatatttggatattcttttttttttttggaatgggaaggattcttttgatagctattcctatttcactatctgatcttaacagatatttggtaagtgacaaccactgaatgaattatctgcttcctttatattttcccattcagtggatttgaaattccttcttgtcttttatgtaagtcttgtcttttatgcttttcatatggactttgttaaagcagatatactctcaccatcttttggtgtgttggataattgtctttaattcttgtttattttctcaaagaaccaattattttattcattatttctttataatgttccacttgcttctagtaaatggatgtcaagccgctttctttgtttcctgttctctactgcacttgaatatacttgatttttcttgttcaatagattctagaggtattgttgtgttgctagcatgagggcattccaatttctatgaaatcaaacaaggctggcctccagttttgcaaagatttaaggaatttgttcaactcagataattcttttgttataattttgacctatttctcatggatagaagaggatgccaatttcagaatttggaggtctcatactttgatgcttacaaagccatggcgaataggtaaaggatgtcaacacaggcctccagggtcatttgggactcttcatttggcctgttaaaggaggcctatgggacagagccttccttagagagagaaaagtattttatgatatagaaccgtgctggctccacaggatgtgttcacaaagggcaatcactggagcaatattccaaacatctcacgctataggtaatttacctatatggatagggtgagatttttattgttgctatgggacccactaccttccaaaattccttcacaatattgcttagggctctcactgaacttcactgcagaatcaatgaggaaacaaaggtttacacattaggttgacacagggaaggaaggggtaaagaaattccactctgattcatgacaacaatgcacaatttggaacaagcaacagtattaacattcaccttatagaggctggaaacacattaatccaaataaatggatcaatggttagctatttgtactgagtactgagccgaggattctcaagatatttaaggaatcaaaatcacagtgagtgctgccatgaaacactgctaggctaaggtcaattgtgatgtggctattgcttcgagactaagcagtaaatctttattggaatgccagagctctttgtgcttccactgatgtttctctatggtagccaggaaaacatgtgtgtgctgggctggtagtaatacaagaggcaaccacaggagagtttctgcacaaggaagttgtgccaatagagcttcagaaaattgtctcacacctctgacatttatttagagaagggacaaccggtgccttcacttcttccctttcctccttagggaaaacatactttcaagtatcaaaaaagggtgcccttgcttccatctaaaatatttcgaccctgcaaccctctccagttacatgtgaccattcctaactctgaagcaattttggaaaggaaggtaagtgtttggtttaggttaggtgatatccaagtacaggtagccgtatactgtctaggcctgggtcaatgatgacaacccaatgtcatgaagaggggtgatgaaataaaattcatgctcaataggattatgctgaggcccaactagggtgacagggacacaagaggtccgttgactctatggggcgctcataagtgacgtccctgagatcctcagatgtccttgcttgttttcccatgagaggaaatggggacatctagggtgcacattggttggcaaacactgcatcccaacaagcacctagtccaacaatggaaatttgggcatttctgcatggatcacctcttgctcatgacaatgtcttttctggtgttttgcagtcatctcacatgcctactgtgaaggcagagaaccacagataatcaggtaagtggtaagaacatggtaaagccaccacctccaggtgacctgacccttatagttttggctttcaattctgagccagtctacccttttggaatttggggttaacaaaattggatgcaatggtaccaaacgaagctcgatttaggttatgttctcaagtgtagaccccctggtttttgaagttttaaggaatgtgctcaactcccagtaatggttttctcataattttgacctacttctcatggagagagggcgatgacattttaagaagatagaaggattctatgatatccaacaaggcttgcctccacatgatgtgttccaaagggcaatttctccagcaaatattccaaaaaactcaccacagagaaaatttacccatgtggatagggtgagattttcatttttaccttggttcccaccaactcccgaattaccaaattacaggggaggcccaagctacagagcctttcttagaaaaaaagaaggattctatgatatccaaaaaggctgtcctccacaggatgggttcacaaaaaaaaaatccctctagcagagtgttgatacctacaaaattgtgaggctaaggtcacatgtgatgtggctgttgcttcgagaagaagcagtaaatctttattggaatgccagggttcctttgtgtgtccactgatgtttctctatggtagccaggaagacttgtgtgtgctggcctggtagtaatacaaaatgtaaacccaggactgtttctgcaaaatgaaattgtgccagtagagctccagaaaaatgtctctctcctctgacctttatttaaagaaggtactacatgcgccttgacttctttccctttccgccttagggaagacattcttccaagtatcaagaaagggagcccttgcttccctggaaggcatttcgtcccagcaatccctctccagttccatgtgaccattcctactctgagccagttttggaaaggaaggtaagtgtttggattaggttaggtgatatccaagtagatgtagccgaattctgtctaggactgggtcaatgatgacaacccaatgtcatgaagaaaggtgatgacataaaattcatgctcaataggattacgctgaggcccaaccaggacgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttactcatgacaatgtcttttctggtgttttgcagtcatctcacatgccaccttggaaggcagagaaacacatataatcaggtaagtggtcagaacatggtaaagcctccacatccaggtgacctcccccttcatgatttggctttcaattctcagccagtcggtccttttggaattagggataacaaaatggtatgcaacggttccaaaggtgctcgatttaggctctgttctcccatgtagatcccctggtttataaagcttcaaggaatgtgttcaactccagataattgttttgaataattttgacctacttctcatggagagaggaggatgatattttttgaatgttgggatctcatactttgatgcttacaattccatggcaaatatctacaggaggacagcacagaactcccgggccttatggtatgcttcctttcccttgaaaggggaggccgaagtgacagtgccttttttagggaaaaagaaggattctatgatatccaaaaggctgtcctccccaggatgggttcaaaatgggcaatccctctagcagatattccaaagatctcaccccagagacaatttacccatgtggataagtgagatattaatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaagtcctgacttgagtccagcaacagtggttaccctcacgttttacagcagggcaacccataacaccttgacacaaatggatccatgtatagacatgggttctgtggcctgggccaaggattctcaggagatttttaggaatcacctttcacgttgagtagggtagtacaacatagaccttaaagaggtctgatgccacatttgcactttgagcaaaaacacacagttacattattcaccctcgaaatacctatctgtagttgttttatttaaattttttttatcctatccatagaacttgggcagctcaacttgagtgttgatacctacaaaattgtgaggctaaggtcacatgtgatgtggctgttgcttcgagaggaagtagtaaaactttattggaatgccagggttcctttgtgtgtccactaatgtttctttatggtagccaggaatacttgtgtgtgctgggctggtagtaatacaaaatgtaaccccaggactgtttctgcaaaatgaagttgtgccagtagagctccagaaaaatgtctctctcctctgacctttatttaaagaagggactacaaacgccttgacttctttccctttcctccttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggtaacagggtcacagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaactgtaccaaaggagctcgatttaggctatgttctccgatgtacatctcctggtttgtaacgttttaaggaatgtgttcaactcccgataattgttttttcataattttgacctacttctcatggagagaggaggatgacattttttgaatgttgggatctcatactttgatgcttacaattccatggcaaatatctacaggaggacagcacagaactcccgggccttatggtatgcttcctttcccttgaaaggggaggccgaagtgacagtgccttttttagggaaaaagaaggattctatgatatccaaaaggctgtcctccccaggatgggttcaaaaagggcaatccctctagcagatattccaaagatctcaccccagagacaatttacccatgtggataagtgagatattaatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaagtcctgacttgagtccagcaacagtggttaccctcacgttttacagcagggcaacccataacaccttgacacaaatggatccatgtatagacatgggttctgtggcctgggccaaggattctcaggagatttttaggaatcacctttcacgttgagtagggtagtacaacatagaccttaaagaggtctgatgccacatttgcactttgagcaaaaacacacagttacattattcaccctcgaaatacctatctgtagttgttttatttaaattttttttatcctatccatagaacttgggcagctcaacttgagtgttgatacctacaaaattgtgaggctaaggtcacatgtgatgtggctgttgcttcgagaggaagtagtaaaactttattggaatgccagggttcctttgtgtgtccactaatgtttctttatggtagccaggaatacttgtgtgtgctgggctggtagtaatacaaaatgtaaccccaggactgtttctgcaaaatgaagttgtgccagtagagctccagaaaaatgtctctctcctctgacctttatttaaagaagggactacaaacgccttgacttctttccctttcctccttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggtaacagggtcacagaggtccgttgactccttggggggctctagggtgacttccctgaagtcgtcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatctcctggtttgtaacgttttaaggaatgtgttcaactcccgataattgttttttcataattttgacctacttctcatggagagaggaggatgacattttttgaatgttgggatctcatactttgatgcttacaattttatggcaaatagctaaaggaggacaacactggcctccagggccttatggtactcttcctttcccttgacaggggaggcccaagtgacagatcctttcttagggaaaaagaaggattctatgatatccaaaaaggctgtcctccccaggatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattcctcattgattcataacaccaaggcctgactttagtccagcaacagtgcttacactcacgttttacagcagggcaacccataacacgttgacacaaatggatacatgtatagacatgggttctgtggcctcggtccaggattctccggagattttcaggaatcacctttcacgttgattcgggtcgtaaaacatagaccttacagaggtctgatgccacatttgcactttgagcaaaaacacacagttactttaatcaccctcgaaatacctatctgtagttgttttattcagttatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccaatgatgtttctctatggtagccaggaagacttgtgtgtgctgggctggtagtaatacaagaggtaaccccagggcagtttatgcacaatgaagttgtacaagtagagctccagaaaaatgtctctcttctctggcctttatttaaagaagggacaacaagcaccttgacttctttccctttcctccttagggaagacattcttccaagtatcaagaaagggagcccttgcttccctggaagacatttcgtcccagcaatccctctccatgtccatgtgaacattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaagtccgatgacaccttggggggctcttgggtgaattccctgaagtccttagatgcccttgccctgtttcccgtgagaggaaatgtggacatctagggtgcacattggttggcaaaaactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtctgttcttttgcaatttggggataacaaaatggtatgcaacggttccaaaggtgctcgatttaggctatgttctcccatgtagatcccctggtttgtaaagctttaaggaatgtgttcaactcccgataattgtttttgaataattttgacgtacttctcatggagagaggaggatgatattttttgaatgttgggatctcatactttgatgcttacaattccatggcaaatatctataggaggacagcacagaactcccgggccttatggtatgcttcctttcccttgaaaggggaggccgaagtgacagtgcctttttttagggaaaaaagaaggattctatgatatccaaaaggctgtcctccccaggaagggttcacaaagggcaatccctctagcagatattccaaagatctcacgccagagacaatttacccatgtggatagggtgagctattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgaatcataacaccaagtcctgacttgagtccagcaacaatggttaccctcacgttttacagcagggcaacccataacaccttgacacaaatggattcatgtatagacatgggttctgtggcctgggcccaggattctcaggagatttttaggaatcacctttcacgttgagtagggtagtacaacatagaacttaaagaggtctaatgccacatttgcactttgagcaaaaacacacagttactttattcaccctcgaaatacctatctgtagttgttttatttaaattttttttatcctatccatagaacttgggcagctcaacttgagtgttgatacctacaaaattgtgaggctaaggtcacatgtgatgtggctgttgcttcgagaggaattagtaaaactttattggaatgccagggttcctttgtgtgtccactaatgtttcctatggtagccaggaatacttgtgtgtgctgggctggtagtaatacaaaatgtaaccccaggactgtttctgcaaaatgaagttgtgccagtagagctccagaaaaatgtctctctcctcggacctttatttaaagaagggactacaagcgccttgacgtctttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattaccctgaggaccaaccaggttaacagggtcacagaggtccgttgactccttggggggctctagggtgacttccctgaagtcctcagatgccctttccctgtttcccatgagaggaaatgtggacatctagggtgcacattggttggcaaaaactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagagcatggtaaagcctccacatccaggtgaccacccccttcatgatttggctttcaattctcagccagtcggtccttttggaattagggattacaaaatggtatacaacggtaccaaaggagctcgatttaggctatgttctccgatgtacatctcctggtttgtaacgttttaaggaatgtgttcaactcccgataattgttttttcataattttgacctacttctcatggagagaggaggatgacattttttgaatgttgggatctcatactttgatgcttacaattttatggcaaatagctaaaggaggacaacactggcctccagggtcttatggtactcttcctttcccttgacaggggaggcccaagtgacagatcctttcttagggaaaaagaaggattctatgatatccaaaaaggctgtcctccccaggatgggttcaaaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagttctacacattaggttgatacagggtaaggccaggtgtttaaagaacctaattccacattgattcataacaccaaggcctgactttagtccagcaacagtgcttatactcacgttttacagcagggcaacccataacacgttgaaacaaatggatacatgtatagacatgggttctgtggcctcggtccaggattctccggagattttcaggaatcacctttcacattgagtcgggtcgtaaaacatagaccttacagagttctgatgccacatttgcactttgagcaaaaacacacagttactttaatcaccctcgaaatacctatctgtagttgttttattcagttatttttttgtcctatccatagaacttgggcagctcaacttgagtgttgatacctacaagatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccagggcagtttatgcacaatgaagttgtacaagtagagctccagaaaaatgtctctctcctctggcctttatttaaagaaaggacaacaagcgccttgacttctttccctttcctccttagggaagacattcttccaagtatcaagaaagggatcccttgcttccctggaagacatttcatcccagcaatccctctccatgtccatgtgaacattcctactctgagccagttttggaaaggaaggtaagtgtttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaagtccgttgacaccttggggggctcttgggtgaattccctgaagtccttagatgcccttgccctgtttcccgtgagaggaaatgtggacatctagggtgcacattggttggcaaacactgcatgccaacaagcacctagtcccacaatggaaccttgggcatttctgcaaggatcgccccttgctcatgagaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtctgttcttttgcaatttggggataacaaaatggtatgcaacggttccaaaggtgctcgatttaggctatgttctcccatgtagatcccctggtttgtaaagctttaaggaatgtgttcaactcccgataattgtttttgaataattttgacgtacttctcatggagagaggaggatgatattttttgaatgttgggatctcatactttgatgcttacaattccatggcaaatatctataggaggacagcacagaactcccgggccttatggtatgcttcctttcccttgaaaggggaggccgaagtgacagtgcctttttttagggaaaaaagaaggattctatgatatccaaaaggctgtcctccccaggaagggttcacaaagggcaatccctctagcagatattccaaagatctcacgccagagacaatttacccatgtggatagggtgagctattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgaatcataacaccaagtcctgacttgagtccagcaacaatggttaccctcacgttttacagcagggcaacccataacaccttgacacaaatggattcatgtatagacatgggttctgtggcctgggcccaggattctcaggagatttttaggaatcacctttcacgttgagtagggtagtacaacatagaccttaaagaggtctaatgccacatttgcactttgagcaaaaacacacagttactttattcaccctcgaaatacctatctgtagttgttttatttaaattttttttatcctatccatagaacttgggcagctcaacttgagtgttgatacctacaaaattgtgaggctaaggtcacatgtgatgtggctgttgcttcgagaggaattagtaaaactttattggaatgccagggttcctttgtgtgtccactaatgtttcctatggtagccaggaatacttgtgtgtgctgggctggtagtaatacaaaatgtaaccccaggactgtttctgcaaaatgaagttgtgccagtagagctccagaaaaatgtctctctcctcggacctttatttaaagaagggactacaagcgccttgacgtctttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattaccctgaggaccaaccaggttaacagggtcacagaggtccgttgactccttggggggctctagggtgacttccctgaagtcctcagatgccctttccctgtttcccatgagaggaaatgtggacatctagggtgcacattggttggcaaaaactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagagcatggtaaagcctccacatccaggtgaccacccccttcatgatttggctttcaattctcagccagtcggtccttttggaattagggataacaaaatggtatacaacggtaccaaaggagctcgatttaggctatgttctccgatgtacatctcctggtttgtaacgttttaaggaatgtgttcaactcccgataattgttttttcataattttgacctacttctcatggagagaggaggatgacattttttgaatgttgggatctcatactttgatgcttacaattttatggcaaatagctaaaggaggacaacactggcctccagggtcttatggtactcttcctttcccttgacaggggaggcccaagtgacagatcctttcttagggaaaaagaaggattctatgatatccaaaaaggctgtcctccccaggatgggttcaaaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagttctacacattaggttgatacagggtaaggccaggtgtttaaagaacctaattccacattgattcataacaccaaggcctgactttagtccagcaacagtgcttatactcacgttttacagcagggcaacccataacacgttgaaacaaatggatacatgtatagacatgggttctgtggcctcggtccaggattctccggagattttcaggaatcacctttcacattgagtcgggtcgtaaaacatagaccttacagagttctgatgccacatttgcactttgagcaaaaacacacagttactttaatcaccctcgaaatacctatctgtagttgttttattcagttatttttttgtcctatccatagaacttgggcagctcaacttgagtgttgatacctacaagatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccagggcagtttatgcacaatgaagttgtacaagtagagctccagaaaaatgtctctctcctctggcctttatttaaagaaaggacaacaagcgccttgacttctttccctttcctccttagggaagacattcttccaagtatcaagaaagggatcccttgcttccctggaagacatttcatcccagcaatccctctccatgtccatgtgaacattcctactctgagccagttttggaaaggaaggtaagtgtttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaagtccgttgacaccttggggggctcttgggtgaattccctgaagtccttagatgcccttgccctgtttcccgtgagaggaaatgtggacatctagggtgcacattggttggcaaacactgcatgccaacaagcacctagtcccacaatggaaccttgggcatttctgcaaggatcgccccttgctcatgagaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtctgttcttttgcaatttggggataacaaaatggtatgcaacggttccaaaggtgctcgatttaggctatgttctcccatgtagatcccctggtttgtaaagctttaaggaatgtgttcaactcccgataattgtttttgaataattttgacgtacttctcatggagagaggaggatgatattttttgaatgttgggatctcatactttgatgcttacaattccatggcaaatatctataggaggacagcacagaactcccgggccttatggtatgcttcctttcccttgaaaggggaggccgaagtgacagtgcctttttttagggaaaaagaaggattctatgatatccaaaaggctgtcctccccaggaagggttcacaaagggcaatccctctagcagatattccaaagatctcaccccagagacaatttacccatgtggatagggtgagatattcatttttaccttggtgccaaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaagtcctgacttgagtccagcaacagtggttaccctcacgttttacagcagggcaatccataacaccttgacacaaatggatccatgtatagacatgggttctgtggcctgggcccaggattctcaggagatttttaggaatcacctttcacgttgagtagggtagtacaacatagaccttaaagaggtctgatgccatatttgcactttgagcaaaaacacacagttactttattcaccctcgaaatacctatctgtagttgttttatttaaatttttttttatcctatccatagaacttgggcagctcaacttgagtgttgatacctacaaaattgtgaggctaaggtcacatgtgatgtggctgttgcttcgagaggaagtagtcaaactttattggaatgacagggttcctttgtgtgtccactaatgtttctctatggtagccaggaagacttgtgtgtgctgggctggtagtaatacaaaatgtaaccccaggactgtttctgcaaaatgaagttgtgccagtagagctccagaaaaatgtctctctcctcggaccttatttaaagaagggactacaagcgccttgacttctttccctttcctccttagggaagacattcttccaagtatcaagaaagggagcccttgcttccctggaagacatttcgtcccagcaatccctctccagttccctgtaaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccaggttaacagggtcacagaggtccgttgactccttggggggctctagggtgacttccctgaagtcctcagatgccctttccctgtttcccatgagaggaaatgtggacatctagggtgcacattggttggcaaaaactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggtgctcgatttagtctatgttctccgatgtacatctcctggtttgtaaagttttaaggaatgtgttcaactcccgataattgttttttcataattttgacctacttctcatggagagaggaggatgacattttttgaatgttgggatctcatactttgatgcttacaattttatggcaaatagctaaaggaggacaacactggcctccagggccttatggtactcttcctttcccttgacaggggaggcccaagtgacagatcctttcttagggaaaaagaaggattctatgatatccaaaaaggctgtcctccccaagatgggttcacaaagggcaatccctctagcagatattccaaagatctcaccccagatacaatttaccaatgtggatagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccacattgattcataacaccaaggcctgactttagtccagcaacagtgcttatactcacgttttacagcagggcaacccataacacgttgacacaaatggatacatgtatatacatgggttctgtggcctcggtccaggattctccggagattttcaggaatcacctttcacgttgagtcgggtcgtaaaacatagaccttacagaggtctgatgccacatttgcactttgagcaaaaacacacagttactttaatcaccctcgaaatacctatctgtagttgttttattcagttatttttttgtcctttccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccagggcagtttatgcacaatgaagttgtacaagtagagctccagaaaaatgtctctctcctctggcctttatttacagaagggacaacaagcgccttgacttctttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagaggtagccaaattctgtccaggactgggtcaatgatgacaacccaatatcatgaagaaaggtgatgacataaaattcatgctcaataggattacgctgaggcccaaccagggcgacagggtcacaagaagtccgttgacaccttggggggctcttgggtgaattccctgaagtccttagatgccctttccctgtttcccgtgagaggaaatgtggacatctagggtgcacattggttggcaaacactgcatgccaacaagcacctagtcccacaatggaaccttgggcatttctgcaaggatcgccccttgctcatgataatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtctgttcttttgcaatttggggataacaaaatggtatgcaacggttccaaaggtgctcgatttaggctatgttctcccatgtagatcccctggtttgtaaagctttaaggaatgtgttcaactcccgataattgtttttgaataattttgacgtacttctcatggagagaggaggatgatattttttgaatgttgggatctcatactttgatgcttacaattccatggcaaatatctacaggaggacagcacagaactcccgggccttatggtatgcttcttttcccttgaaaggggaggccgaagtgacagtgcctttttttagggaaaaagaaggattctatgatatccaaaaggctgtcctccccaggaagggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaagtcctgacttgagtccagcaacagtgcttacactcacgttttacagcagggcaacccataacacgttgacacaaatggatacatgtatagacatgggttctgtggcctgggtccaggattctcgggagattttcaggaatcaactgtcacgttgagtcgggtcctacaacatagaccttacagaggtctgatgccacatttgcactttgagcaaaaacacacagttactttaatcaccctcgaaatacctatctgtagttgttttattcaattattttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtttctctcctcggacctttatttaaagaagggactacaagagccttgacttctttccctttcctccttagggaagacattcttccaagtatcaagaaagggagcccttgcttccctggaagatatttcgtcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattaccctgaggcccaaccagggtaacagggtcacagaggtccgttgactccttggggggctctagggtgacttccctgaagtcctcagatgccctttccctgtttcccatgagaggaaatgtggacatctagggtgcacattggttggcaaaaactgcatgccaacaagcacctagtcccacaatggaaccttgggcatttctgcaaggatcgccccttgctcatgacaatgtcttttctggtgttttgcagtcatctcacatgccacctggaaggcagagaaacacagataatcaggtaagtggtcagaacatggtaaagcctccacatccaggtgacctcccccttcatgatttggctttcaattctcagccagtcgttccttttggaattagggataacaaaatggtatacaacggtaccaaaggagctcgatttaggctatgtttttagatgtacatcccctggtttgtaacgttttaaggaatgtgttcaactcccgataattgttttttcataattttgacctacttctcatggagagaggagaatgacattttttgaatgttgggatctcatatttgatgcttacaattttatggcaaatagctacaggaggacaacactggcctccagggccttatggtactcttcctttcccttgacaggggaggcccaagtgacagatcctttcttagggaaaaagaaggattccatgatatccaaaaaggctgtcctccccaggatgggttcacaaagggcaatccctctagcagatattccaaagatctcaccccagagacaatttaccaatgtggatagggtgagatattcatttttaccttggtacccaccacattgcaaatttccttcatggtatcatttagggcacttactgaacctcactgcagaatcactgaggaaaaaaagctctacacattaggttgatacagggtaaggccaggtgtttaaagaacctaattccacattgattcataacaccaaggcctgactttagtccagcaacagtgcttatactcacgttttacagcagggcaacccataacacgttgacacaaatggatacatgtatagacatgggttctgtggcctcggtccaggattctccaaagattttcaggaatcacctttcacgttgagtcgggtcgtacaacatagaccttacagaggtctgatgccacatttgcactttgagcaaaatcacacagttactttaatcaccctcgaaatacctatctgtagttgttttattcagttatttttttgtcctatccatagaacttgggcagctcaacttgattgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaattgtctctcccctctgaccattatttaaagaagggacaacaagcgactcgacttctttccctttcctccttagggaagacattcttccaagtatcaagaaagggagcccttgcttccctggaagacatttcgtcccagcaatccctctcaagttccatgtgaccattcctactctgagccagttttggaaaggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatgaaaccttgggcatttctgcaaggatcgccccacgctcatgacaatgtcttttctggtgttttgcagtcatctcacatgccaccttggaaggcagagaaacacagataatcaggtaagtggtcagaacatggtaaatcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaaggttttaaggaatgtgttcaactcccgataattgttttttcataattttgacctacttctcatggagagaggaggatgacattttttgaatgttgggatctcatactttgatgcttacaattttatggcaaatagctacaggaggacatcactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagatctcaccccagagacaatttaccaatgtggatagggtgagatattcatttttaccttggtacccaccacattgcaaatttccttcctggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctgggtccaggattctcgggagattttcaggaatcacctgtcacgttgagtcgggtcctacaacatagaccttacagaggtctgatgccacatttgcactttgagcaaaaacacacagttactttaatcaccctcgaaatacctatctgtagttgttttattcaattattttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttattaaagaagggacaacaagcgtcttgacttctttccctttcctccttagggaagacattcttccaagtatcaagaaagggagcccttgcttccctggaagacatttcgtcccagcaatccctctccagttccctgtaaccattcctactctgagccagttttggaaaggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccaggttaacagggtcacagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccagttgacctcccccttcatgatttggctttcaattctcagccagtcggtccttttggaattagggataacaaaatggtatacaacggtaccaaaggagctcgatttaggctatgttctccgatgtacatcccctggtttgtaacattttaaggaatgtcttcaactcccgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaaagactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggacgacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaagaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggcctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccagcaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaataagcacctagtcccacaatggaaccttgggcatttctgcaaggatctccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggacgacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccagggtgtttaaagaacctaattccactttgatttcataccaccaaggcctgactttattccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggaagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccagcaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaataagcacctagtcccacaatggaaccttgggcatttctgcaaggatctccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggacgacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcattcctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacacaatggtatacaacagtaccaaaggagctggatttaggctatgttctccgatgtacatcccctggtttgtaacgttttaaggaatgtgttcaactccagataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacagatcctttcttagggaaaaacaaggattctatgatatccaaaaaggctgtcctccccaggatgggttcacaaagggcaatccctctagaagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctccgtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattattttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttattaaagaagggacaacaagcgtcttgacttctttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcgcacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcacgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcgctgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcactgttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaaaaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcattcctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacacaatggtatacaacagtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaaggctgtcctccccaggatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcgctgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcactgttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaaaaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaagtgatgacataaaattcatgctcaataggattaggctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaacaaggattctatgatatccaaaaaggctgtcctccccacgatgtgttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttactctcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttttgtgtccactgatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaaaaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggacgacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcattcctgcaaggatcaccccttgctcatgacaatgtcttttctggtgttttgcagtcatctcacatgccaccttggaaggcatagaaacacagataatcaggtaagtggtcagaacatggtaaagcctccacatccaggtgacctcccccttcatgatttggctttcaattctcagccagtcggtccttttggaattagggataacacaatggtatacaacagtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaaggctgtcctccccaggatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattattttttgtcctatccatagaacttcggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatatagttgtacaagtagagctccagaaaaatgtctctctcctctgacctttattaaagaagggacaacaagcatcttgacttctttccctttcctccttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacactgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcgcacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcacgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcactgttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccatttcctccttagggaagacattctaccaagtatcaagaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaagtgatgacataaaattcatgctcaataggattaggctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaacaaggattctatgatatccaaaaaggctgtcctccccacgatgtgttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttactctcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttttgtgtccactgatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactattcctttcccttgacaggggaggcccaagtgacagatcctttcttagggaaaaagaaggattctatgatatccaaaaaggctgtcctactcaggatgggttcacaaagggcaatccctctagcagatattccaaagatctcaccccagagacaatttaccaatgtggatagggtgagatattcatttttaccttgttacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccaggaacagtgcttacactcacgttttacagcagggcaacccataacacgttgacacaaatggatacatgtatagacatgggttctgtggcctcggtccaggattctctggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctccactgacctttatttaaagaagggacaacaagcgtcttgactactttccctttcctccttagggaagacattcttccaagtatcaagaaagggatcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcaagatttggctttcaattctcagccagtcggtccttttggaattagggataacaaaatggtatacaagggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacagatcctttcttagggaaaaacaaggattctatgatatccaaaaaggctgtcctccccaggatgggttcacaaagagcaatccctctagcagatattccaaagatctcaccccagagacaatttaccaatgtggatagggtgagatattcatttttaccttggtaccaaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttaacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacagatcctttcttagggaaaaacaaggattctatgatatccaaaaaggctgtcctccccaagatgggttcacaaagagcaatccctctagcagatattccaaagatctcaccccagagacaatttaccaatgtggatagggtgagatattcatttttaccttggtaccaaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattatgttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacatattctttcttaggaaaaaagaaggattctttgatatccaaaaagtctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccaggaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccattgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcatcttgacttcttttcctttcctccttagggaagacattcttccaagtatcaagaaagggagcccttgcttccctggaagacatttcctcccagcaatcactctccagttccatgtgaccattcctactctgatccagatttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacagatcctttcttagggaaaaacaaggattctatgatatccaaaaaggctgtcctccccaagatgggttcacaaagagcaatccctctagcagatattccaaagatctcaccccagagacaatttaccaatgtggatagggtgagatattcatttttaccttggtaccaaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacatatcctttcttaggaaaaaagaaggattctttgatatccaaaaagtctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccaggaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccattgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcatcttgacttcttttcctttcctccttagggaagacattcttccaagtatcaagaaagggagcccttgcttccctggaagacatttcctcccagcaatcactctccagttccatgtgaccattcctactctgatccagatttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacatatcctttcttaggaaaaaagaaggattctttgatatccaaaaagtctgtcctccccaggatgggttcacaaagtgcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttactctcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgttcactaatgtttctctatggtagccagcaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagagagcccttgcttccctggaagacatttcctcccagcaatccctctccagttccatgtgaccattcctactctgagccagttttggaaaggaaggtaagtggttggattaggttaggtgatatccaagtagatgtagctgaattctgtctaggactgggtcaatgatgacaacccaatgtcatgaacaaaggtgatgacataaaattcatgctcaataggattacgctgaggcccaaccagggcgtcagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcgtgatttggctttcaattctcagccagtcggtccttttggaattagggataacaaaatggtatacaacggtaccaaaggagctcgatttaggctatgttctccgatgtacatcccctggtttgtaacgttttaaggaatgtgttcaactcccgaaaattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagacctcaacccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacatatcctttcttaggaaaaaagaaggattctttgatatccaaaaagtctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccaggaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccattgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcatcttgacttcttttcctttcctccttagggaagacattcttccaagtatcaagaaagggagcccttgcttccctggaagacatttcctcccagcaatcactctccagttccatgtgaccattcctactctgatccagatttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggccgaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaaacacctagtcccacaatggaaccttgggcatttctgcaaggatcgccccttgctcatgacaatgtcttttctggagttttgcagtcatctcacatgccaccttggaaggcagagaaacacagataatcaggtaagtggtcagaacatggtaaagcctccacatccaggtgacctcccccttcatgatttggctttcaattctcagccagtctgttcttttgcaatttggtgataacaaaatggtatgcaacagtaccaaaggagctcgatttaggctatgttctccgatgtacatcccctggtttgtaacgttttaaggaatgtcttcaactcccgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaagaaggattctatgatatccaaaaaggctgtcctccacacgatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttactctcacgttttacagcagggcaacccataacaggttgacacaaatggatacatgtatagacatgggttctgtggcctcggtccaggattctctggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccagcaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagagagcccttgcttccctggaagacatttcctcccagcaatccctctccagttccatgtgaccattcctactctgagccagttttggaaaggaaggtaagtggttggattaggttaggtgatatccaagtagatgtagctgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcaactagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatgagggataacaaaatggtatacaacggtaccaaaggagctcgatttaggctatgttctccgatgtacatcacctggtttgtaacgttttaaggaatgtcttcaactcccgataattgttttttcataattttgacctacttctcatggagagaggaggatgacagtttttgaatgttgggatctcatactttgatgcttacaatttcattgcaaatagctacaggaggacaacactggcctccagggccttatggtactcttcctttcccttgacaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttactctcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaatgttttaaggaatgtcttcaactcccgataattgttttttcataattttgacctacttctcatggagagaggaggatgacattttttgaatgttgggatctcatactttgatgcttacaattttatggcaaatagctacaggaggacaacactggtctccagggccttatggtactcttcctttcccttgacaggggaggcccaagtgacagatcctttcttagggaaaaagaaggattctatgatatccaaaaaggctgtcctccccaggatgggttcacaaagggcaatccctctagcagatattccaaagagctcaccccagagacaatttaccaatgtggatagggtgagatattcatttttaccttggtacccaccacattccaaatttccttcatagtatcatttagggcacttactgaacctcactgcagaatcactgaggaaaaaaaactctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacattttctgcacaatgaagttgtacaagtagagctccagaaaaatgtctctctcctctgacctttattaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggataggaaggtaagtggttggattaggttaggtgatatccaagtagatgtagctgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcaagatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaatctgtcctccccaggatgggttcacaaagggcaatccctctagcagatattccaaagatctcaccacagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaagtcctgacttgaggacttgagtccagcaacagtggttaccctcaggttttacagcagggcaacccataacacgttgacacaaatggatacatgtatagtcatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttatcggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgacttctttccctttcctccttagggaagacattcttccaagtatcaagaaagggagcccttgcttccctggaagacatttcctcccagcaatccctctccaggtccatgtgaccattcctactctgatccagatttggaaaggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcccaataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaatgaaggattctatgatatccaaaaaggctgtccttcccacgatgtgttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctgggagtaatacaagaggtaactccaggacagtttctgcacaatgaagttgtacaagtagagctccagaaaaatgtctctctcctctgacctttatttaaagaagggacaacaagcttcttgactactttccctttcctccttagggaagacattcttccaagtatcaagaaagggtgcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcatattggttggcaaacactgcatgcaaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcgtgatttggctttcaattctcagccagtcggtccttttggaattagggataacaaaatggtatacaacggtaccaaaggagctcgatttaggctatgttctccgatgtacatcccctggtttgtaacgttttaaggaatgtgttcaactcccgaaaattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagacctcaacccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttacttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgccctttccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacggtttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacatatcctttcttaggaaaaaagaaggattctttgatatccaaaaagtctgtcctccccaggatgggttcacaaagtgcaatccctctaccagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccaggaacagtgcttacactcacgttttacagcagggcaacccataacacgttgacacaaatggatacatgtatagacatgggttctgtggcctgggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctcggctggtagtaatacaagaggtaaccccaggacattttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggataggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcaagatttggctttcaattctcagccagtcggtccttttggaattagcgataacaaaatggtatacaacggtaccaaaggagctcgatttaggctatgttctccgatgtacatcccctggtttgtaacgttttaaggaatgtcttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagacctcaacccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccagaacacgttgacacaaatggatacatgtatagaaatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctgggagtaaaacaagaggtaactccaggacagtttctgcacaatgaagttgtacaagtagagctccagaaaaatgtctctctcctcggacctttatttaaagaagggacaacaagggactcgacttctttccctttcctccttagggaagacatacttccaagtatcaagaaagggagcccttgcttccctggaagacatttcgtcccagcaatccctctccagttccatgtgaccattcctactctgagccagttttggaaaggaaggtaagtgattggattaggttaggtgatatccaagtagatgtagccgaattctgtctaggactgggtcaatgatgacaacccaatgtcatgaagaaaagtgatgacataaaattcatgctcaataggattacgctgaggcccaaccagggcgacagggtcacaagaggtccgttgacaccttggggggctctagggtgacttccctgaagtcctcagatgcccttgccctgtttcccatgagaggaaatgtggacatctagggtgcatattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcgtgatttggctttcaattctcagccagtcggtccttttggaattagggataacaaaatggtatacaacggtaccaaaggagctcgatttaggctatgttctccgatgtacatcccctggtttgtaacgtttaaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagacctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgattttagtccagcaacagtgcttacactcacgttttacagcagggcaacccagaacacgttgacacaaatggatacatgtatagaaatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatatggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgacttctttccctttccactttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccaaattctgtctaggactgggtcaatgatgacaacccaatgtcatgaagaaaggtgatgacataaaattcatgctcaataggattacgctgaggcccaaccagggcgacagtgtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagttggtccttttggaattagggataacaaaatggtatacaacggtaccaaaggagctcgatttaggctatgttctccgatgtacatcccctggtttgtaacgttttaaggaatgtcttcaactcccaataattttttttcataattttgacctacttctcatggagagaggaggatgacattttttgaatgttgggatctcatactttgatgcttacaattttatggcaaatagctacaggaggacaacactggcctccagggccttatggtactcttcctttcccttgagaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcttacaacatagaccttacagaggtctgatgccacatttgcactttgagcaaaaacacacagttactttaatcaccctcgaaatacctatctgtagttgttttattcaattatttttttgtcctatccatagaacttgggcaactcaacttgagtgttgatacctacaaaatggtgaggctaaggtgacctgtgatgttgctgttgcttcgagaggaagcagtaaatctttattggaatgccagggttttttgtgtgtccactgatgtttctctatggtagccaggaagacttgtgtgtgctgggctgggagtaatacaagaggtaactccaggacagtttctgcacaatgacgttgtacaagtagagctccagaaaaatgtctctctcctctgacctttatttaacgaagggacaacaagcgactcgaattctttccctttcctccttagggaagacattcttccaagtatcaagaaagggagcccttgcttccctggaagacatttcgtcccagcaatccctctccagttccatgtgaccattcctactctgagccagatttggaaaggaaggtaagtgattggattaggttaggtgatatccaagtagatgtagccgaattctgtctaggactgggtcaatgatgacaacccaatgtcatgaagaaaagtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcgtgatttggctttcaattctcagccagtcggtccttttggaattagggataacaaaatggtatacaacggtaccaaaggagctcgatttaggctatgttctccgatgtacatcccctggtttgtaacgtttaaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagacctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgattttagtccagcaacagtgcttacactcacgttttacagcagggcaacccagaacacgttgacacaaatggatacatgtatagaaatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatatggctgttgcttcgagaggaagcagtaaatctttattggaatgccagggttccgttgtgtgtccactgatgtttctctatggtatccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgacttctttccctttccactttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccaaattctgtctaggactgggtcaatgatgacaacccaatgtcatgaagaaaggtgatgacataaaattcatgctcaataggattacgctgaggcccaaccagggcgacagtgtcacaagaggtccgttgactccttggggggctctagggtgacttccctgaagtcctcagatgccctttccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcccaataattttttttcataattttgacctacttctcatggagagaggaggatgacattttttgaatgttgggatctcatactttgatgcttacaattttatggcaaatagctacaggaggacaacactggcctccagggccttatggtactcttcctttcccttgagaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtgacctgtgatgttgctgttgcttcgagaggaagcagtaaatccttatttgaatgccagggttttttgtgtgtccactgatgtttctctatggtagccaggaagacttgtgtgtgctgggctgggagtaatacaagaggtaactccaggacagtttctgcacaatgacgttgtacaagtagagctccagaaaaatgtctctctcctctgacctttatttaacgaagggacaacaagcgtcttgacttctttccctttccactttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccaaattctgtctaggactgggtcaatgatgacaacccaatgtcatgaagaaaggtgatgacataaaattcatgctcaataggattacgctgaggcccaaccagggcgacagtgtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcccaataattttttttcataattttgacctacttctcatggagagaggaggatgacattttttgaatgttgggatctcatactttgatgcttacaattttatggcaaatagctacaggaggacaacactggcctccagggccttatggtactcttcctttcccttgagaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatataagaggtaaccccaggacagtttctgcacaatgaagttgtacaagtagagctccagaaaaatgtctctctcttctgacctttatttaaagaatggacaacaagcgtcttgacttctttcccgttcctccttagggaagacattcttccaagtatcaagaaagggagcccttgcttccctggaagacatttcgtcccagcaatcactctccagttccttgtgaccattcctattctgagccagttttggaaaggtaggtaagtggttggattaggttaggtgatttccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgccctttccctgtttcccatgataggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttttaacgttttaaggaatgtgttcaactcccgataattgttttttcataattttgacctacttctcatggagagaggaggatgacattttttgaatgttgggatctcatactttaatgcttacaattttatggcaaatagctacaggaggacaacacttgcctccagggccttatggtactcttcctttcccttgacaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacactgtaaggccaggtgtttaaagaacctaattccactttgattcataacaccaaggcctgactttagtccagcaacagtgcttacactcacgttttacagcagggcaacccataacacgttaacacaaatggatacatatatagacatgggttctgtggcctaggtccaggattctcgggagattttcaggaatcacctttcacgttgagtcgggtcttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagcgtcttgacttctttcccgttcctccttagggaagacattcttccaagtatcaagaaagggagcccttgcttccctggaagacatttcgtcccagcaatcactctccagttccttgtgaccattcctactctgagccagttttggaaaggtaggtaagtggttggattaggttaggtgatttccaagtagaggtagccgaattctgtctaggactgggtcaatgatgacaacccaatgtcatgaagaaaggtgatgacataaaattcatgctcaataggattacgctgaggcccaaccagggcgacagtgtcacaactggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatagtatacaacggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttaatgaacctcactgcagaatcactgaggaaaaaaagctctacacattaggttgatacagggtaaggccaggtgtttaaagaatctaattccactttgattcataacaccaaggcctgactttagtccagcaacagtgattacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaatggacaacaagcgtcttgacttctttcccgttcctccttagggaagacattcttccaagtatcaagaaagggagcccttgcttccctggaagacatttcgtcccagcaatcactctccagttccttgtgaccattcctactctgagccagttttggaaaggtaggtaagtggttggattaggttaggtgatttccaagtagtggtagccgaattctgtctaggactgggtcaatgatgacaacccaatgtcatgaagaaaggtgatgacataaaattcatgctcaataggattacgctgaggcccaaccagggcgacagggtcacaactggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatagtatacaatggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatactttcttagggaaaaagaaggattctatgatatccaaaaaggctgtcctccccaggatgggttcacaaagggcaatccctctagcagatattccaaagatctcaccccagagacaatttaccaatgtggatagggtgagaaattcatttttaccttggtacccaccacattccaaatttccttcatggtatcatttagggaacttactgaacctcactgcagaatcactgaggaaaaaaagctctacacattaggttgatacagggtaaggccaggtgtttaaagaatctaattccactttgattcataacaccacggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcggatcctacaacatagaccttacagaggtctgatgccacatttgcactttgagcaaaaacacacagttactttaatcaccctcgaaatacctatttgtagttgttttattcaattatttttttgtcctatccatagaacttgggcagctcaacttgagtgttgatacctacaaaatggtgaggctaaagtcacctgtgatgtggctgttgcttcgagaggaagcagtaaatctttattggaatgccagggttcctttatgtgtccactgatgtttctctatggtagccaggaagacttgtgtgtgctgggctggtagtaatacaagaggtaaccccaggacagtttctgcacaatgaagttgtacaagtagagctccagaaaaatgtctctctcctctgaccttaatttaaagaagggacaacaagcgtcttgacttctttccctttcctgcttagggaagacattcttccaagtatcaagaaagggagcccttgcttccctggaagacattttgtcccagcaatccctctccagttccatgtgaccattcctactctgagccagttttggaaaggaaggtaagtggttggattaggttaggtgatatccaagtagaggtagccgaattctgtccaggactgggtcaatgatgacaacccaatgtcatgaagaaaggtgatgacataaaattaatgctcaataggattacgctgaggcccaaccagggcgacagtgtcacaactggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaatatggtaaagcctccacatccaggtgacctcccccttcatgatttggctttcaattctcagccagtcggtccttttggaattggggataacaaaatggtatacaacggtaccaaaggagctcgatttaggctatgttctccgatgtacatcccctggtttgtaacgttttaaggaatgtgttcaactcccgataattgttttttcttaattttgacctacttctcatggagagaggaggatgacattttttgaatgttgggatctcatactttgatgcttacaattttatggcaaatagctacaggaggacaacactggcctccagggccttatggtattcttcctttcccttgacaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacactgtaaggccaggtgtttaaagaacctaattccactttgattcataacaccaaggcctgactttagtccagcaacagtgcttacactcacgttttacagcagggcaacccataacacgttaacacaaatggatacatatatagacatgggttctgtggcctaggtccaggattctcgggagattttcaggaatcacctttcacgttgagttgggtcttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccacagatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagcttcttgacttctttccctttcctccttagggaagacattcttccaagtatcaagaaagggagcccttgcttccctggaagacatttcgtcccagcaatccctctccagttccatgtgaccattcctactctgagccagttttggaaaggaaggtaagtgtttggattaggttaggtgatatccaagtagatgtagccgaattctgtctaggactgggtcaatgatgcaacccaatgtcatgaagaaagttgatgacataaaattcatgctcaataggattacgctgaggcccaaccagggcgacagggtcacaagaggtccgatgactccttggggggctctagggtgaattccctgaagtcctcagatgcacttgccctgtttcccatgagaggaaatgtggacatctagggtgcacattggttggcaaacactgcatgccaacaagcacctagtcccacaatggaaccttgggcatttctgcaaggatcgccccttgttcatgacaatgtcttttctggtgttttgcagtcatctcacatgccaccttggaaggcagagaaacacagataatcaggtaagtggtcagaacatggtaaagccttcacatccaggtgacttcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtattcttcctttcccttgacaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacactgtaaggccaggtgtttaaagaacctaattccactttgattcataacaccaaggcctgactttagtccagcaacagtgcttacactcacgttttacagcagggcaacccataacacgttaacacaaatggatacatatatagacatgggttctgtggcctaggtccaggattctcgggagattttcaggaatcacctttcacgttgagtcgggtcttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccacagatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagcttcttgacttctttcccgttcctccttagggaagacattcttccaagtatcaagaaagggagcccttgcttccctggaagacatttcgtcccagcaatccctctccagttccatgtgaccattcctactctgagccagttttggaaaggaaggtaagtgtttggattaggttaggtgatatccaagtagatgtagccgaattctgtctaggactgggtcaatgatgcaacccaatgtcatgaagaaagttgatgacataaaattcatgctcaataggattacgctgaggcccaaccagggcgacagggtcacaagaggtccgttgactccttggggggctctagggtgacttccctgaagtcctcagatgcacttgccctgtttcccatgacaggaaatgtggacatctagggtgcacattggttggcaaacactgcatgccaaaaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagccttcacatccaggtgacttcccccttcatgatttggctttcaattctcagccagtcggtccttttggaatttggggataacaaaatggtatgcaaaggtaccaaaggagctcgatttaggctatgttctccgatgtacatcccctggtttgtaacgttttatggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctcgccaggatgggttcacaaagggcaatccctctagcagatattccaaacatctcaccccagagacaatttatcaatgtggatatggtgagatattcatttttaccttggtacccaccacattccaaatttccttcatggtatcatttagggcacttactgaacctcactgcagaatcactgaggaaaaaaagctctacacattaggttgatacagggtaaggccaggtggttaaagaaccttattccactttgattcataacaccaaggcctgactttagtccagcaacagtgcttacactcacgttttacagcagggcaacccataacacgttgacacaaatggttccatgtatagacatgggttctgtggcctcggtccaggattctcgggagattttcaggaatcacctttcacgttaatcgggtcttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaagaagacttgtgtatgctgggctggtagtaatacaagaggtaaccccaggacagtttctgcacaatgaagttgtacaagtagagctccagaaaaatgtctctctcctctgacctttatttaaagaagggacaacaagcttcttgacttctttcccgttcctccttagggaagacattcttccaagtatcaagaaagggagcccttgcttccctggaagacatttcgtcccagcaatccctctccagttccatgtgaccattcctactctgagccagttttggaaaggaaggtaagttgttggattaggttaggtgatatccaaatataggtagccgaattctgtctaggactgggtcaatgatgacaacccaatgtcatgaagaaaggtgatgacataaaattcatgctcaataggattacgctgaggcccaaccagggcgacagggtcacaagtggtccgttgactccttgggggtctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaagtaccaaaggagctcgatttaggctatgttctccgatgtacatcccctggtttgtaacgtttaaaggattgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatatggtgagatattcattattaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccaaaacacgttgacacaaatggatacatgtatagacatgggttctgtggccttggtccaggattctcgggagattttcaggaatcacctttcacattgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtatgctgggctggtagtaatacaagaggtaaccccagggcagtttctgcacaatgaagttgtacaagtagagctccagaaaaatgtctctctcctctgacctttatttaaagaagggacaacaagcttcttgacttctttccctttcctccttagggaagacattcttccaagtatcaagaaagggagcccttgcttccctggaagacatttcgtcccaggaatccctctccagatccatgtgaccattcctactctgagccagttttggaaagtaaggtaagtggttggattaggttaggtgatatccaagtagaggtagccgaattctgtctaggactgggtcaatgatgacaaccaaatgtcatgaagaaagttgatgacataaaattcatgctcaataggattactctgaggcccaaccagggtgacagggtcacaggaggtccgttgactccttggggggctctagggtgatttccctgaagtcctcagatgccctttccctgtttcccatgagaggaaatgtggccatctagggagcacattggttggcaaacactgcatgccaacaagcacctagtcccacaatggaaccttgggcatttctgcaaggatcgccccttgctcatgacaatgtcttttctggtgttttgcagtcatctcacattccaccttggaaggcagagaaacacagataatcaggtaagtggtcagaacatggtaaatcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttttaacgttttaaggaatgtgttcaactcccgataattgttttttcataattttgacctacttctcatggagagaggaggatgacattttttgaatgttgggatctcatactttgatgctttcaattttatggcaaataggtacaggaggacaacactgtcctccagggccttatggtactcttcctttcccttgaaaggggaggcccaagtaacagatcctttcttagggaaaaagaaggattctatgatatccaaaaaggctgtcctacccaggatgggttcacaaagggcaatccctctagcagatattccaaagatctcaccccagagacaatttaccaatgtggatatggtgagatattcatttttacctttgtacccaccacattccaaatttccttcagggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccaaaacacgttgacacaaatggatacatgtatagacatgggttctgtggcctcggtccaggattctcgggagattttcaggaatcacctttcacgttgaatcgggtcctacaacatagaccttacagaggactgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcccaatgaagttgtacaagtagagctccagaaaaatgtctctctcctctgacctttatttaaagaagggacaacaagcgtcttgacttctttccctttcctccatagggaagacattcttccaagtatcaagaaagggagcccttgcttccctggaagacatttcatcccagcaatccctctccagttccatgtgaccattcctactctgagccagttttggaaaggaaggtaagtggttggattaggttatgtgatatccaagtagaggtagccgaattctgtctaggactgggtcaatgatgacaacccaatgtcatgaagaaaggtgatgacataaaattcatgctcaataggattacactgaggcccaaccagggcgacagggtcacaagaggtccgttgactccttggggggctctagggtgacttccctgaagtcctcatatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcattccttttggaattagggataacaaaatggtatacaaaggtaccaaaggagctcgatttaggctatgttctccgatgtacatcccctggtttgtaacgttttaaggaatgtgttcaactcccgataattgttttttcataattttgacctacttcttatggagagaggaggatgacattttttgaatgttgggatctcatactttgatgcttacaattttatggcaaatagctacaggaggacaacactggcctccagggccttatggtacccttcctttcccttgacaggagaggcccaagtgaccgatcctttcttagggaaaaagaaggattctatgatatccaaaaaggctgtcctccccaggatgggttcacaaagggcaatccctctagcagatattccaaagatctcaccccagagacaatttaccaatgtggatatggtgagatattcatttttacctttgtacccaccacattccaaatttccttcagggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccaaaacacgttgacacaaatggatacatgtatagacatgggttctgtggcctcggtccaggattctcgggagattttcaggaatcacctttcacgttgaatcgggtcctacaacatagaccttacagaggactgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcccaatgaagttgtacaagtagagctccagaaaaatgtctctctcctctgacctttatttaaagaagggacaacaagcgtcttgacttctttccctttcctccatagggaagacattcttccaagtatcaagaaagggagcccttgcttccctggaagacatttcatcccagcaatccctctccagttccatgtgaccattcctactctgagccagttttggaaaggaaggtaagtggttggattaggttatgtgatatccaagtagaggtagccgaattctgtctaggactgggtcaatgatgacaacccaatgtcatgaagaaaggtgatgacataaaattcatgctcaataggattacactgaggcccaaccagggcgacagggtcacaagaggtccgttgactccttggggggctctagggtgacttccctgaagtcctcatatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcattccttttggaattagggataacaaaatggtatacaaaggtaccaaaggagctcgatttaggctatgttctccgatgtacatcccctggtttgtaacgttttaaggaatgtgttcaactcccgataattgttttttcataattttgacctacttcttatggagagaggaggatgacattttttgaatgttgggatctcatactttgatgcttacaattttatggcaaatagctacaggaggacaacactggcctccagggccttatggtacccttcctttcccttgacaggagaggcccaagtgaccgatcctttcttagggaaaaagaaggattctatgatatccaaaaaggctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacagggttaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttctggaatcacctttcacgttgagtcgggtcgtacaacacagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagagcaagcagtaaatctttattagaatgccagggttcctttgtctgtccactgatgtttctttatggtagccaggaagacttgtgtgtgctgggctggtagtaatacaagaggtaaccccaggacagtttctgcacaatgaagttgtacaagtagagctccagaaatatgtctctctcctctgacctttatttaaagaagggacaacaagcgtctttacttctttccctttccactttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagttgtagccaaattctgtctaggactgggtcaatgatgacaacccaatgtcatgaagaaagttgatgacataaaattcatgctcaataggattacgctgaggcccaaccagagcgacagggtcacaagaggtccgttgactccttgggctgctctagggtgacttccatgaagtcctcaggtgcccttgccctgtttcccatgagaggaaatgtggacatctagggtgcacattggttggcaaacactgcatgccaacaagcacctagtcccacaatggaaccttgggcatttctgcaaggatcgcccctttctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaattgtatgcaaaggtaccaaaggagctcgatttaggctatgttctccgatgtacatcccctggtttgtaacgttttaaggaatgtgttcaactccccataattgttttttcataattttgacctacttctcatggagagaggaggatgacattttttgaatgttgggatctcatactttgatgcttacaattttatggcaaatagcttcaggaggacaacactggcctccagggccttatggtactcttcctttcccttgacaggggaggcccaagtgacagatcctttcttagggaaaaagaaggattctatgatatccaaaaagtctgtcctcgccaggatgggttcacaaagggcaatccctctagcagatattccaaacatctcaccccagagacaatttatcaatgtggatatggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatccatgtatagacatgggttctgtggcctcagtccaggattctcgggagattttcaggaatcacctttcacgttgactcgggtcgtacaacatagacattacagaggtctgatgccacatttacactttgagcaaaaacacacagttactttaatcaccctcgaaatacctatctgtagtttttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgaagtttctctatggtagccaggaagacttgtgtgtgctgggctggtagtaaccccaggacagtttctgcacaatgaagttgtacaagtagagctccagaaaaatgtctctctcctctgacctttatttaaagaagggacaacaagtgccttgacttctttccctttcctccttagggaagacattcttccaagtatcaagaaagggagaccttgcttccctggaagacattttgtcccagcaattcctctccagtttcatgtgaccattcctactctgagccagttttggaaatgaaggtaagtggttggattaggttaggtgatatccaagtagatgtagccgaattctgtctaggactgtgtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacacttcatgccaacaagcacctagtcccacaatggaaccttgggcatttctgcaaggatcgccccttgttcatgacaatgttttttctggtgttttgcagtcatctcacatgccaccttggaaggcagagcaacacagataatcaggtaagtggtcagaacatggtaaagcctccacatccaggtgacctcccccttcatgatttggctttcaattctcagcctgtcggtccttttggaattagggataacaaaatggtatacaacggtaccaaaggagctcaatttaggctatgttctccgatgtacatcccctggtttgtaacgttttaaggaatgtgttcaactcccgataattattttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatacccaaaaaggctgtcctcgccaggatgggttcacaaagggcaatccctctagcagatattccaaagatctcaccccagagacaatttaccaatgtggatagggtgagatattcatttttaccttggtacccaccacattccaaatttccttcatggtatcatttagggtacttaatgaacctcactgcagaatcactgaggaaaaaaagctctacacattaggttgatacagggtaaggccaggtgtttaaagaacctaattgcactttgattcataacaccaaggcctcacttgagtccagcaacagtggttaccctcacgttttacagcagggcaacccataacaccttgacacaaatggatccatgtatagacatgggttctgtggcctgggcccaggattctcgggagattttcaggaatcacctttcacgttgagttgggtcttacaacatagaccttacagaggtctgatgccacatttgcactttgagcaaaaacacacagttactttaatcaccctcgaaatacctatctgtagttgttttattcaattatttttttgtcttatccataacttgggcagctcaacttgagtgttgatacctacaaaatggtgaggctaagttcacctgtgatgtggctgttgctttgagaggaagcagtaaatcttattggaatgccagtgttcctttgggtgtccactgatgtttctctatggtagccaggaagacttgtgtatgctgggctggtaatacaagaggtaaccccaggacagtttctgcacaatgaagttgtacaagtagagctccagaaaaatgtctctctcctctgacctttatttaaagatgggacaaccagcgtcttgacttctttccctttcctccttagggaagacattcttccaagtatcaagaaagggagcccttgcttccctggaagacatttcgtcccagcaatccctctccagttccatgtgaccattcctactctgagccagttttggaaaggaatgtaagtggttggattaggttaggtgatatccaagtagaggtagccgaattctgtccaggactgggtcaatgatgacaacccaatgtcatgaagaaaggtgatgacataaaattcatgctcaataggattacgctgaggcccaaccagggcgacagggtcactagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaagagctcgatttaggctatgttctccgatgtacatcccctggtttgtaacgttataaggaatgtgttcaactcccgataattgttttttcataattttgacctacttttcatggagagaggagcatgacattttttgaatcttaggatctcatactttgatgcttacaattttatggcaaataggtacaggaggacaacacaggcctccagggccttatgagactcttcctttcccttgacaggggaggcccaagtgacagagcctttcttagggaaaaagaaggattttatgatatccaagaagggtgtcctccccaggatgggttcacaaagggcaatcactctagcagatattctaaagatctcaccccagagacaatttacccatgtggaaagggtgagatattcatttttaccttggtacccaccacattccaaattttcttcatggtatcatttagggcacttactgaacctcactgcagaatcacttaggaaaaatagctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaacacacagttactttaatcaccctcgaaatacctatctgtagttgttttattcaattattttttgtcttatccatagaacttgggcagctcaacttgagtgttgatacctacaaaatggtgaggctaaggtcacctgtgatgtggctgttgcttcgagaggaagcagtaaatcttattggaatgccagggttccattgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagtgtcttgacttctttccctttcctccttagggaagacattcttccaagtatcaagaaagggagcacttgcttccctggaagacatttcatcccagcaatccctctccagttccatatgaccattcctactccgagccagttttggaaaggaaggtaagtggttggattaggttaggtgatatccaagtagaggtagccgaattctatctaggactgggtcaatgatgacaacccaatatcatgaagaaaggtgatgacataaaattcatgctcaataggtttacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagccagtcagtccttttggaattagggataacaaaatggtatacaatggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttggaatctcatactttgatgcttacaattttatggcaaatagctacaggaggacaacactggcctccagggccttatggtactcttcctttcccttgacaggggaggcccaagtgacagatactttcttagggaaaaagaaggattctatgatatccaaaaaggctgtcctccccaggatgggttcacaaagggcaatcccaaagatctcaccccagagacaatttaccaatttggatagggtgagatattcatttttaccttggtactcaccacattccaaatttccttcatggtatcatttagggcacttactgaacctcactgcagaatcactgaggaaaaaaagctctacacattaggttgatacagggtaaggccaggtgtttaaagaacctaattccactttgattcataataccaaggcctgactttagtccagtatctgtgcttacactcatgttttacagcagggcaacccataacatcttaaatgcgttctcatgaccagccaggaagaacacaacaaatcagaatcttctgcggcaaaactttattgcttacatcttcaggagccaggagcgcaagccccaagccccaaaaacgaaaggcccccgcttacatctttaggaaccagagcgccagtgcgccagagcgccagcgcgccagagcaaaagcgcaagagcgcaagtaagagagagaatggcgggaaccccgtccccttttaaggagaattatccttcacctaggacgcatcactccctgtttggctgcagcccatggccgagtaaaggcagagtacatgtagtggaaaattactcttggcacatgcgcagattatttgtttaccacttagaacacaggatgtcagcgccatcttgtgacggcgaatgtgggggtggctcccaacatctccccctttccttttaataagagcaataggccacccatattaatgagagtggagatagaggtcaaatccccagtgtgcaagtaaaggagccatgtacatgcttagctcttaggctcacaggcttttacccagagcaaccctgacctgctcccgtgtcgttttgcctggagagaaggacacttggacactcaaccttcttgcaagatgacatgtctccctagaataggctcatatatgccgcagagcccttctactgcagtgcttagccgtgcaactctctcaggctgctgaagcacactcactctatctcgtgcaatgagtctagcctcgtgggatgtaagagctgagtggccagcgacctattgcctaagcatagatatattaggggaagcaccatgttctagagctgtaagtgtctaggcaataaccaccttgtctctcctagtttgggccttaagcttacagaccaaccaaagaagcaacactaatccacagcaaagtgtatctccaaataatatcaatcccacccattctttaaagaagggaaatgctgaggagatccaattgggtaatcctttagtcagggacaggtccaagcgcgtggagttgacctgaagtctcaattcccgaaagatctgttcaaattcagccgtccaattctgtaacatatactgaaaaagactttttgacaaattagctgccctagtaaaattctcatactgaatggaagtaatggacaatcccggaaacttttgttcacatcccagctgagttatttgccataatacatctagttgtttctggacaagatctatgagttgattaaccagcatgagaccaccctgtatcttgacattagctgaggcctgtttatctatgactgtagtcactgaggctgacaaagtgttaatggtgtcagtcgtctggacctgtccagacagagccaaggctgtctgaatcaaggccaaacccagttcctagttagtggtaaaaaagcaggggaatacttgagcattatacatcaccgtcattaggagtggaaatgtcgacattatcccccaacgctgctctctctttattattgacgccctggacatcaccaagacgagggacatcagtattcccttggtcagtctggatttttcgggtgagtctttctggtatccaaaatgggttgtcttcattctgtgggaaaacacaaaccgctcccctggatcttatcaaaataggatccgggccataccatttattatcaaggacatttttccatttaaccatctcattgggcctatctggctctgaacaatgacgttcagccgcagtatggccatgaacatcaatatttaaaaaattgagtgtaaagagtgccatagacacagacactcttggtactcggggtagagtctcctcaattcccctcttctgttttataagataggctttgagggtgcgatgcgcacgctcaacaataccctgtccttgagggttgtatggaagtccagtcaggtgggtcacgtccatctgacggcagaactgctggaatttttgagatgtataagctggtccattatcagtcttaaggagtttgggtttcccccaagcactccatgcctcaagacaatgttgaatcacatgtgaggctttttctccggttaacggagaagcaaacatgatgccagaacatgtgtcaatggacacatggagatattgaagttttccaaaggaagaaacatgtgtaacatccatttgccagacctgtagaggtcgaataccgcgtgggttaattcccacatgaggaactggcaagatctcacagcagctttgacattgagtaacaatgtcacgggcttcttttcttgtcaaggagaaacgactgcgtaatgtttcagctgtcacatgaaaattgttatgaaaatttcttgcagcctctaccggggatgatagggcagcagccaccactttagtggccttatctgccaaatcatttcccagagccatggggccaggtaggcctgaatgggctctaacatgagtaatataaacaggaaatcttctagataacaaaactaattgtatctgctgaaaaatattggcaactctactggaaggcttaatcactccagccacttctaaaagatttactgcattaaccacataacaggaatctgatacaatattaaggggttctaaaaaggtttttaaaacttctaaaaccactaaacattctaccacttgaggtgaatttacattatattgtttggataccactttaccattagccacataggcacctatgccagtttttgatccatcagtatataccacaatcccatttttaagtgggtttcttactgttatttgtggaaacacaacagattgattttgggcaaactgtaaaattggatgttttggataatggttatctatttgtcctgaaaaggaggtaactaaaactgcccaatcattagatgtggctgtcaaggtttgaacctgtgcagcggtataaggtacaattaaaagatatggacttcgcccaaagtgggtgattgctgcttttaggcctttaagggcaagctgtgcaattgcatcaggataccaatctattattttagctggggatacgtttggatggatccacaacaatggcccattctgccacaaaactgcggttggcaattgtgctgtcttaaagacacacaaactgaaaggctgcgaatcctcaatacgttgtaattgtgcattctgtaaggctttttccaccttttgtaaggccgggttagcagctagagtaagagccctaggggaggagatatgaggatctccttctaaaataccaaacaaaggccttaactcagcggaaggaatctttaaaaaaggtctgagccaattaatatctcccaacagcttttgaaaatcatttaaggtatggaggtgatctcttcttatctctaccttttggggcacaatcttatctggggacaccacagagcccaagaattgtcctgtatcagaaatttggactttttctgtggctatctgtaaaccccactgacttaaagttttaagtagaaaaggatatgccttttgtagcatggtaaggtttttatggcacaggaggatgtcatccatgtaaaggagcaaaattaaagaggggaattgttccctcactggcaaaagagcttcttgcacataaagttggcacatagtaggactattggacattccctgtggtaagaccttccattgatacctcttatcaggttccatgtgattaatagaggggatggtaaaggcaaatctgggcctatcccttggacacaaaggtatagaaaagaaacaatctttaatatctataataattaaattccagccacgtggtaaggcggaatgtacagggagacccctctgtactgggccaaataagttcatttgctcattaatggctctgaggtcatggagcagtctccactttcctgactttttcttaattacaaaaattggagtattccaaggtgaggtagagggttcaatatggcctagttttaattgttcctctaccagttgaatcacagcttccagtttttcagaggataggggccattgaggaacccacactggatcccctgttttccatggtatgggccgtgctgccccaatggccactaaggaaaacccagaccctgtctgtcttggtttccattaggtgagatgggctctatccttccctgttcttgatgtcctaacccttttccttctttataacccatctttgccatgatattttttgctttagctgaatatcctcccgatggggcgttttcattggacaaaataaggcccaaatgctgcataatatcccttccccagaggttaaccgggagtgggagcacataaggtatgaatttcccttgctgcccttcagaggattcccacgtcaaggcaatggaacttatagtgggacatgattgataacctaggccctgtaatgaatgagatgactctgtggtgggccatgctttgggccaccaatgtgtagaaattatacttttatctgctccggtatcaaggatgccttcaaactcttttccgttgatcttaaggcggagcttaggtctatcattcaaagatacaaccaaataggcagaatcatttcctgaggagcccattttctttatctcaggtcctgcaaatttctccctggtattatcagggaggagcagcagctgagctatcctatctcctttactaatagaaaaaacgcccttagggcttgagcacaggacctgtatttcaggggaatgttgacaatccataactccagggtggactactaagccctgcaaggtgagtgaaccccggccaagaataaggcccatggttcccgggggcaaggatggtataggctccactggcaccggctgaatactcatttgaggcattaataggaagtcggaggcggcacgcaggtccacccttgtgggtcttcctgggtcgcctctctgactgcttcctgggtcctgacaaaccggttcccatatctttgagggccctgggaccgagggcccgatgacccgtttttttggcacataagctgattgactatcaggtgggggaaggattctgccctttatatccctcacagagcgacactggtcggctctatgataacccttgccacacttagagcaaagagtgagagtccctccctgtttatctggagctctgcaatctttcttaagatgcccaggctttccacagttaaaacatgtcctctgatcatttcttcccatggagcggttttgggattaaaggatggcagccgctaaacctgcattgctgagaggtcccccaagctctcgacaaactctgagccagtcttgtaagcctttgttctttcttggggctatggccgctcggcactcctttgtggcttgctcatagatgagctgttctaccagaggtgcggcttgctctgagtctccaaaaatatgctctgctgcctctgtcattctggccacaaaatctgagaaggactcctgaggtccctggacgatctttgttaattgcccagtggcttcacctgctcgggagagcgccttccaggccctaatagccgtggaggaaatttgggcataagctccccaatggtagtttgtctgatcagcagaataagctccctgacccgttaacaagtcaaaagtccaatctctctgctctgtagtcaaagcagctgcgtttgttcgggcctgtgcttgtgcagcctcatgccaaagcgctctccattccatatatttgcccatactagggagagcggcttttacaatcgtttgccagtcagcaggagttagtgccatgccggcaagcctgtctaactgcaccaaggtaaaattagcattggttctgtatttacggaccgactcggcaagttctttaatctgcacgtattctaccggagcgtggacacgcccaccctcggctccttcaaagaccggaaatgcctgttgtattttcctttgttcctctctgggaatgaatgagtctgcgcattgcctctctgcgcattgtctctctgcgcattgtctctctgcgcagggctgacgcactacgcagggcgggggctccgcatagggcggaccttgaagccgactgcccgcaggctgaacagcatgctggctttcgccagccgcttttggcttttttcttgaccaactagctagcactttatctggctggtaatgagctgcttcttcctcccagtctgtttcttcagaggagaattcttcatctgcttcagagctactaagagctggcttcctgagctcatctagtgacgagtatctcctagagacctccgctaattaatcttttttcttttcttttttcttttccttccttctaatctctccccaggtattcttacctgacctaaacttttccttgggttcaagacccttggaaaggcctgtatacttattctgtgcaccatatttcctctttgctcctactctctctccccgctttacttctgatagattgtcctgaatttcatctagaattttcagccctatcttaatcacttgataacatgtgaaaaagaacaaaagggctcctaacactagaaaaagttcaaggccaaacataccttgtaaagctattttccactttacttctgatagactgtcttgaatttcgttagaaagttcaagaccagacttaccttgtaaagctgtactcactggtactcctgttccccagctgaaaagttctgaattcatgcagttgaatccttctcaacagtctgttttacgggaacctttattaccgtgacccgcagttctggttccggaatgagggatcttccttgcgccggtgatggttaactcccgtcccgagttttcttgtattttctcgtcccgggtttttttcttcccggattttctcgtcccgggtttcggcaccaactcttaaacgcgttctcacgaccagccaggaagaacacaacaaaccagaatcttctgcggcaaaactttattgcttacatcttcaggagccaggagcgcaagccccaagccccaaaaacgaaaggcccacgcttacatctttaggagccagagcgccagcgcgccagagcaaaagcgcaagagcgcaagtaagagagagaatggcggaaaccccatccccttttaaggagaattatccttcgcctaggacgcatcactccctgattggctgcagcccatggccgagtaaaggcagagtacatgtagtggaaaattactcttggcacatgcgcagattatttgtttaccacttaagaacacaggatgtcagcgccatcttgtgacggcgaatgtgggggcggctcccaacaataacacattgacacaaatggatacatgtatagatatgggttctgtggccttggtccaggattctcaggagattttcaggaatcacctttcacgttgagtcgggtcatacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtaatacaagaggtaaccccaggacagtttctgcacaatgaagttgtacaagtagagctccagaaaaatgtctctctcctctgacctttatttaaagaagggacaacaagcgtcttgacttctttccctttcctccttagggaagacattcttccaagtatcaagaaagggagcccttgcttccctggaagacatttcgtcccagcaatccctctccagttccatataaccattcctactctgagccagttttggaaaagaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggccctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatctccccttgctcatgacaatgtcttttctggtgttttgcagtcatctcatatgccaccttggaaggcagagaaacacagataatcaggtaagtggtcagaacatggtaaagcctccacatccaggtgacctcccccttcatgatttggctttcaattctcagcatgtcagtccttttggaattagggataacaaaatggtatacaatggtaccaaaggagctcgatttaggctatgttccccgatgtacatcccctggtttgtaacgttttaaggaatgtgttcaactcccgataattgttttttcataattttgacctacttctcatggagagaggagaatgacattttttgaatgttgggatctcatactttgatgcttacaattttatggaaaatagctacaggaggacaacactggcctccagggccttatggtactcttcctttcccttgacaggggaggcccaagtgacagatcctttcttagggaaaaagaaggattctatgatatccaaaaaggctgtcctccccaggatgggttcacaaagggcaatccctctagcagatattccaaagatctcaccccagagacaatttaccaatttggatagggtgagatattcatttttaccttggtacccaccacattccaaatttccttcatggtatcatttagggcacttactgaacctcactgcagaatcactgaggaaaaaaagctctacatattaggttgatacagggtaaggccaggtgtttaaagaacctaattccactttgattcataacaccaaggcctgactttagtccagcaacagtgcttacactcacattttacagcagggcaacccataacacgttgacacaaatggatacatgtatagacatgggttctgtggccttggtccaggattctcgggagattttcaggaatcacctttcacgttgagtcgggtcgtacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgttgtggctgttgcttcgagaggaagcagtaaatctttattggaatgccagggttcctttgtgtgtccactgatgtttctctatggtagccaggaagacttgtgtgtgctgggctggtagtaatacaagatgtaaccccaggacagtttctgcacaatgaagttgtaccagtagagctccagaaacatgtctctctcctctgacctttatttaaagaagggacaacaagcgtctttacttctttccctttcctccttagggaagacattctttcaagtatcaagaaagggagcccttgcttccctggaagacatttcgtcccaacaatccctctcaaattccatatgaccattcctactctgagccagttttggaaaggaaggtaagtggttggattaggttaggtgatatccaagtagaggtagccgaattctgtctaggactgggtcaatggtgacaacccaatgtcatgaagaaaggtgatgacataaaattcatgctcaataggattacgctgaggcccaaccagggcgacagggtcacaactggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcatatgccaccttggaaggcagagaaacacagataatcaggtaagtggtcagaacatggtaaagcctccacatccaggtgacctcccccttcatgatttggctttcaattctcagccagttggtccttttggaattagggataactaaatggtatacaacggtaccaaaggagctcgatttaggctatgatctcagatgtacaacccctggattgtaacgttttaaggaatgtgttcaactcccaataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttaggtaaaaagaaggattctatgatatccaaaaaggctgtcctccccaggatgggttcacaaagggcaatccctctagcagtgattccaaagatctcaccccagagtcaatttaccaatttggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttaaactcacgttttacagaagggcaacccataacacgttgacaaaaatggatacatgtatagacatgggttctgtggcctcggtacaggattctcaggagattttcaggaatcacctttcacggtgagtcgggtcgtacaacatagactttacagaggtctgatgccacatttgctctttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctttgatgtggctgttgcttcgagaggaagcagtaaatctttattggaatgccagggttcctttgtgtgtccactgatgtttctctatggtagccaggaagacttgtgtgtgctgggctggtaatacaagaggtaaccccaggacagtttctacacaatgaagttgtacaagtagagctccagaaaaatgtctctctcctctgacctttatttaaagaagggacaacaagcgtctttacttctttccctttcctcgttagggaagacattcttccaagtatcaagaaagggagcccttgcttccctggaagacatttcctcccagcaatccctctccagttccatatgaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttgggggctctagggtgacttccctgaagtcctcagatgcccttgccctgtttcccatgagaggaaatatggacatctagggtgcacattggttggcaaacactgcatgccaacaagcacctagtcccacaatggaaccttgggcatttctgcaaggatcgccccttgctcatgacaatgtcttttctggtgttttgcagtcatctcatatgccaccttggaaggcagagaaacacagataatcaggtaagtggtcagaacatggtaaagcctccacatccaggtgacctcccccttcatgatttggctttcaattctcagccagttggtccttttggaattagggataacaaaatggtatacaacggtaccaaaggagctcgatttaggctatgttctccgaagtacaacccctggattgtaacgttttaaggaatgtgttcaactcccgataattgttttttcataattttgaccttcttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttaggtaaaaagaaggattctatgatatccaaaaaggctgtcctccccaggatgggttcacaaagggcaatccctctagcagtgattccaaagatctcaccccagagtcaatttaccaatttggatagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttaaactcacgttttacagaagggcaacccataacacgttgacaaaaatggatacatgtatagacatgggttctgtggcctcggtacaggattctcaggagattttcaggaatcacctttcacggtgagtcgggtcgtacaacatagactttacagaggtctgatgccacatttgctctttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctttgatgtggctgttgcttcgagaggaagcagtaaatctttattggaatgccagggttcctttgtgtgtccactgatgtttctctatggtagccaggaagacttgtgtgtgctgggctggtaatacaagaggtaaccccaggacagtttctgcacaatgaagttgtacaagtagagctccagaaaaatgtctctctcctctgacctttatttaaagaagggacaacaagcgtctttacttctttccctttcctcgttagggaagacattcttccaagtatcaagaaagggagcccttgcttccctggaagacatttcctcccagcaatccctctccagttccatatgaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttgggggctctagggtgacttccctgaagtcctcagatgcccttgccctgtttcccatgagaggaaatatggacatctagggtgcacattggttggcaaacactgcatgccaacaagcacctagtcccacaatggaaccttgggcatttctgcaaggatcgccccttgctcatgacaatgtcttttctggtgttttgcagtcatctcatatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaatggtaccaaaggagctcgatttaggctatgttccccgatgtacatcctctggtttgtaacgttttaaggaatgtgttcaactcccgataatcgttttttcataattttgacctacttctcatggagagaggagaatgacattttttgaatgttgggatctcatactttgatgcttacaattttatggcaaatagctacagggggacaacactggcctccagggccttatggtactcttcctttcccttgacaggggaggcccaagtgacagatcctttcttagggaaaaagaaggattctatgatatccaaaaaggctgtcctccacaggatgggttcacaaagggcaatccctctagcagatattccaaagatctcaccccagagacaatttaccaatttggatagggtgagatattcatttttaccttggtacccaccacattccaaatttccttcatggtatcatttagggcacttactgaacctcactgcagaatcactgaggaaaaaaagctctacatattaggttgatacagggtaaggccaggtgtttaaagaacctaattccactttgattcataacaccaaggcctgactttagtccagcaacagtgcttaaactcacgttttacagcagggcaacccataacacgttgacacaaatggatacatgtatagacatgggttctgtggccttggtccaggattctcgggagattttcaggaatcacctttcacgttgagtcgggtcgtacaacatagaccttacagaggtctgatgccacatttgcactttgagcaaaatcacacagttactttaatcaccctcgaaatacctatatgtagttgttttattcaattatttttttgtcctatccatagaacttgggcagctcaacttgagtgttgatacctacagaatggtgaggctaaggtcacctatgttgtggctgttgcttcgaaaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtaccagtagagctccagaaacatgtctctctcctctgacctttatttaaacaagggacaacaagcgtcttgacttctttccctttcctccttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaacaaaggtgatgacataaaattcatgctcaataggattacgctgaggcccaaccagggcaacagggtcacaagaggtccgttgactccttggggggctctagggtgacttccctgaagtactcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgaaaatgtcttttctggtgttttgcagtcatctcacatgccaccttggaaggcagagcaacacagataatcaggtaagtggtcagaacatggtaaagcctccacatccatgtgacctcccccttcatgatttggctttcaattctcagccagtcggtccttttggaatttggggataacaaaatggtatgcaaaggtaccaaaggagctctatttaggctatgttctccgatgtacatcccctgatttgtaaccttttttaggaatgtgtttaactcccgataattgttttttcataattttgacctacttctcattgagagaggagcatgacattttttgaatcttaggatctcatactttgatgcttacaattttatggtaaatagctacaggaggacaatacaggcctccagggccttatgggactcttcctttttcttgacaggggaggcccatgtgacagagcctttcttagggaaaaagaaggattttatgatatccaaaaaggctgtcctccccaggatgggttcacaaagggcaatccctctagcagataatccaaagttctcaccccagagaaaatttaccattgtggaaagggtgagatattcatttttaacttggtgcccaccacattccaaatttccttcatggtatcatttagggcacttactgaacctcactgcagaatcactgaggaaataaagctctacacattaggttgatacagggtaaggccaggtgtttaaagaacctaattgcactttgattcataacaccaaggcctgacttgagtccagcaacagtggttatcctcacgttttacagcagggcaacccataacaccttgacacaaatggatccatgtatagacatgggttctgtggcctggtcccaggattctcgcgagattttcagtaatcacctttcacgttgagtcgggtcttacaacatagaccttacagaggtctgatgccacatttgcactttgagcaaaaacacacagttactttaatcaccctcgaaatacctatctgtagttgttttattcaattatttttttgtcttatccatagaacttgggcagctcaacttgagtgttgatacctacaaaatggtgaggctaaggtcacctgtgatgtggctgttgcttcgagaggaagcagtaaatcatattggaatgccagggttcctttgtgtgttcactgatgtttctctatggtacccaggaagacttgtgtgtgctgggctggtagtaatacaagaggtaaccccaggacagtttctgcacaatgaagttgtaccagtagagctccagaaacatgtctctctcctctgacctttatttaaagaagggacaacaagcgtcttgacttctttccctttcctcctttgggaagacattcttccaagtatcaagaaagggagcccttgcttccctggaagacatttcgtcccagcaatccctctccagttccatgtgaccattcctactctgagccagttttggaaagaaggtaagtggttggattaggttaggtgatatccaagtagaggtagccgaattctgtctaggactgggtcaatgatgacaacccaatgtcatgaagaacggtgatgacataaaattcatgctcaataggattacgctgaggcccaaccagggcgacagggtcacaagaggtccgttgactccttggggggctctagggtgacttccctgtagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctctatttaggctatgttctccgatgtacatcccctgatttgtaaccttttttaggaatgtgtttaactcccgataattgttttttcataattttgacctacttctcattgagagaggagcatgacattttttgaatcttaggatctcatactttgatgcttacaattttatggcaaatagctacaggaggacaacacaggcctccagggccttatgggactcttcctttcccttgacagtggaggcccaagtgacagagcctttcttagggaaaaagaaggattttatgatatccaaaaatgctgtcctccccaggatgggttcacaaagggcaatccctctagcagatattccaaagatctcaccccagagacaatttaccattgtggaaagggtgagatattcatttttaacttggtgcccaccacattccaaatttccttcatggtatcatttaggacacttactgaacctcactgcagaatcactgaggaaataaagctctacacattaggttgatacagggtaaggccaggtgtttaaagaagctaattgcactttgattcataacaccaaggcctgacttgagtccagcaacagtggttatcctcacgttttacagcagggcaacccataacaccttgacacaaatggatccatgtatagacatgggttctgtggcctgggcccaggattctcgcgagattttcagtaatcacctttcatgttgagtcgggtcttacaacatagaccttacaaaggtctgatgccacatttgcactttgagcaaaaacacacagttatttaatcaccctcgaaatacctatctgtagttgttttattcaattatttttttgtcttatccatagaacttgggcagctcaacttgagtgttgatacctacaaaatggtgaggctaaggtcacctgtgatgtggctgttgcttcgagaggaagcagtaaatcttattggaatgccagggttcctttgtgtgttcactgatgattctctatggtagccaggaagacttgtgtatgctgggctggtagtaatacaagaggtaaccccaggacagtttctgcacaatgaagttgtacaagtagagctccagaaaaatgtgtctctcctctgacctttatttaaagaagggacaacaagcgccttgacttctttccctttcctccttagggaagacattcttccaagtatcaaaaagggagcccttgcttccctggaagacatttcgtcccagcaatcccgctccagttccatgtgaccattcctaatctgagccagttttgaaaaggaaggtaagtggttggattatattaggtgatatccaagtagaggtagccgaattctgtctaggactgggtcaatgataacaacccaatgtcatgaagaaaggtgatgacataaaattcatgctcaataggattacgctgaggcccaaccagggcgacaggatcacaagagggtctgttgactccttggggagctctagggtgacttccctgaagtcctcagatgcccttgccctgttccccatgagaggaaatgtggacatctagggtgcacattggttggcaaacactgcatgccaacaagcacctagtcccacaatggaaccttgggcatttctgcaaggatctccccttgctcatgacaatgtcttttctggtgttttgcagtcatctcatatgccaccttggaaggcagagaaacacagataatcaggtaagtggtcagaacatggtaaagcctccacatccaggtgacctcccccttcatgatttggctttcaattctcagcatgtcagtccttttggaattagggataacaaaatggtatacaaaggtaccaaaggagctcaatttagactatgttctccgacgtacatcccctggtttgtaacgttttaaagaatgtgttcaactcccgataattgttttttcataattttgacctacttctcatggagagaggaggatgacattttttgaatgttgggatctcatacattgatgcttacaattttatggcaaatagctccaggaggacaacactggcctccagggccttatggtacacttcctttcccttgagaggggaggcccaagtgacagatcctttcttaggtaaaaagaaggattctatgatatccaaaaaggctgtcctccccaggatgggttcacaaagggcaatccctctagcagatattccaaagatctcaccccagagacaatttactcatatggattgggtgagatattcatttttgccttgctgcccaccacattccaaatttccttcattttatcatttaggacacttactgaacctcactgcagaatcactgaggaaaaaaaggtctagacattaggttgatacagggtaaggcaacgtgtttaaagaacctaattccactttgattcataacaccaaggcctgatttgagtccagcaacagtgcttacactcacgttttacagcagggcaacccaaatcaccttgacacaaataaatccatgtatagacatgggttctgtggcctgggcccaggattctcgggagattttcaggaatcacctttcacgttgagtctggtctttcaacatagaacttacagaggtctgatgccacatttgcactttgagcaaaaacacagttactttaatcaccctcaaaatacctatctgtagttgttttattcaattattttttgtcttatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtatgctgggctggtagtaatacaagaggtaaccccaggacagtttctgcacaatgaagttgtaccagtagagctccagaaaaatgtctctctcctctgacctttatttaaagaagggacaacaagcgtcttgacttctttccctttcctccttagggaagacattcttccaagtatcaagaaagggagcccttgcttccctggaagacatttcgtcccagcaatcccgctccagttccatgtgaccattcctactctgagccagttttggaaaggaaggtaagtggttggattatgttaggtgatatccaagtagaggtagccgaattctgtctaggactgggtcaatgatgacaacccaatgtcatgaagaacggtgatgacataaaattcatgctcaataggattacgctgaggcccaaccagtgcgacagggtcacaagaggtccgttgactccttggggggctctagggtgacttccctgtagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacaaataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctctatttaggctatgttctccgatgtacatcccctgatttgtaaccttttttaggaatgtgtttaactcccgataattgttttttcataattttgacctacttctcattgagagaggagcatgacattttttgaatcttaggatctcatactttgatgcttacaatttcatggcaaatagctacaggaggacaacacaggcctccagggccttatgggactcttcctttcccttgacaggggaggcccaagtgacagaccctttcttagggaaaaagaaggattctctgatatacaaaaaggctgtcctcccaaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaattactgaggaaaaaaatctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtccggtcgtacaacatagaccttacagaggtctgatgccacatttgcacgttgagcaaaaacacacagttactttaatcaccctcgaaatacctatctgtagttgttttattcaattacttttttgtcctatccatataacttgggtagctcaacttgagtgttgatacctacaaaatggtgaggttaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacatgaggtaaccccaggacagtttctgaacaatgaagttgtacaagtagagctccagaaaaatgtctctctcctctgacctttattgaaagaagggacaacaagcgtcttgacatctttccctttcctccttagggaagacattcttccaagtatcaagaaagggagcccttgcttccctggaagacatttcgtaagagcaatttctccccagttctgtgtgaccattcctactctgagccagttttggaaaggaaggtaagtggttggattaggttaggtgatatccaagtagaggtagccgaattctgtctaggactaggtcaatgatgacaacccaatgtcatgaagaaaggtgatgacataaaattcatgctcaataggtttatgctgaggcccaaccagtgcgacagggtcacaagaggtccgttgactttttggggggctctagggtgacttccctgaagtcctcagatgcccttgccctgtttcccatgagaggaaatgtggacatctagggtgcacagtggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtgttcaactcccgataattgttttttcataattttgacctacttctcatggagagaggagaatgacattttttgaatgttgggatctcatactttgatgcttacaattttatggcaaatagctacaggaggacaacactggcctccaggaccttatgggactcttcctttcccttgagaggggaggcccaagtgacagatcctttcttagggaaaaagaaggattctatgatattcaaaaaggctgtcctccccaggatgggtttacaaagggcaatccctctagcagatattccaaagatctcacccctgagacaatttaccaatgtggatagggtgagatattcatttttaccttggtacccaccacattccaaatttccttcatggtatcatttagggcacttactgaacctcactgcagaatcactgaggtaaaaaagctctacacattaggttgatacagggtaatgccaggtgtttaaagaacctaattgcactttgattcataacaccaaggcctgacttgagtccagcaacagtggataccctcacgttttacagcagggcaacccatagcaccttgacacaaatggataaatgtgtagacatgggttctgtggcctgggcccaggattctcgggagattttcaggaatcacctttcacgttgagttgggtcttacaacatagaccttacagagctctgatgccacatttgcactttgagcaaaaacacacagttactttaatcacccttgaaatacctatctgtagttgttttattcaattattttttttgtcctatccatagaacttgggcagctcaacttgagtgttgatacctacaaaatggtgaggctaaggtcacctgtgatgtggctgttgcttcgagaggaagcagtaaatctttattggaatgccatagttcctttgtgtgtccactgatgtttctgtatggtagccaggaagacttgtttgtgctgggctggtagtaataaatgaggtacccccaggacaatttctgcacaatgaagttgtaccaatagagctccagaaaaatgtctctctcctcagacctttatttaaagatgggacaacaagcgtcttgacttctttccctttcctccttaggaaagacattcttccaagttgcttccctggaagatatttcgtcccagcaatccctctccagttccatgtgaccattcctactctgagccagttttggaaaggaaggtaagtggttggattaggttaggtgatatccaagtagaggtagccgaattccgtctaggactgggttaatgatgacaacccaatgtcatgaagaaaggtgatgacataaaattcatgctcaataggattacgctgaggcccaaccagggcgacagggtcacaagaggtccgttgactctttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggattgccccttgctcatggcaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataaaaaatggtatacaaccgtacaaaaggagctcgatttaggctatgttctccgatgtacatcccctggtttgtaacgttttaaggaatgtgttcaactccctataattgttttttcataattttgacctacttctcatggagagaggaggatgacattttttgaatgttgggatctcataccttgatgcttacaattccatggcaaatagcttcaggaggacaacacagggctccagggcctcatgggagtcttcctttcccttgacaggggaggcccaagtgacagaccctttcttagggaaaaagaaggattctatgatatccaaaaaggctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcaggagattatcaggaatcaactttttatgttgagtcgggtcttacaacatagaccttacagaggtctgatgccacatttgcactttgagcaaaaacacacagttattttaatcaccctcgaaatacctatctgtagttgttttattcaattatttttttgtcctatccatagaacttgggcagctcaacttgagtgttgatacctacaaaattgtgaggctaaggtcacctgtgatgtggctgttgcttcgagaggaagcagtaaatctttattggaatgccaggattcctttgtgtgtccactgatgtttctctatggtagccaggaagacttgtgtgtgctgggctggtagtaatacaagaggtaacccgaggacagtttctgaacaatgaagttgtacaagtagagctccagaaaaatgtctctctcctctgacctttatttaaagaagggacaacaagcgtcttgacttctttccctttcctccttagggaagacattcttccaagtatcaagaaagggagcccttgcttccctggaagacatttcgtcccagcaatccctctccagttccatatgaccattcctactctgagccagttttggaaaggaaggtaagtggttggattaggttagttgatatccaagtagatgtagccgaattctgtctaggactgggtcagtgatgacaacccaatgtcatgaagaaaggtgttgacataaaattcatgctcaataggattacgctgaggcccaaccagggcgacagggtcagaagaggtccgttgactccatggggggctctagggtgacttccctgaagtcctcagatgcccttgccctgtttcccatgagaggaaatgtggacatctagggtgcacattggttggcaaacattgcatgccaacaagcacctagtcccacaatggaaccttgggcatttctgcaaggatcgccccttgctcatgacaatgtcttttctggtgttttgcagtcatctcatatgccaccttggaaggcagagaaacacaggtaatcaggtaagtggtcagaacatggtaaagcctccacatccaggtgacctcccccttcatgatttggctttcaattctcagcatgtcagtccttttggaattagggataacaaaatggtatacaatggtaccaaaggagctcgatttaggctatgttccccaatgtacatcccctggtttgtaacgttttaaggaatgtgttcaactcccgataattgtgttttcataattttgacctacttctcatggagagaggagaatgacattttttgaatgttgggatctcatactttgatgcttacaattttatggcaaatagctacaggaggacaacactggcctccaggaccttatgggactcttcctttcccttgagaggggaggcccaagtgacagatcctttcttagggaaaaagaaggattctatgatattcaaaaaggctgtcctccccaggatgggtttacaaagggcaatccctctagcagatattccaaagatctcacccctgagacaatttaccaatgtggatagggtgagatattcatttttaccttggtacccaccacattccaaatttccttcatggtatcatttagggcacttactgaacctcactgcagaatcactgaggtaaaaaagctctacacattaggttgatacagggtaatgccaggtgtttaaagaacctaattgcactttgattcataacaccaaggcctgacttgagtccagcaacagtggataccctcacgttttacagcagggcaacccatagcaccttgacacaaatggataaatgtgtagacatgggttctgtggcctgggcccaggattctcgggagattttcaggaatcacctttcacgttgagttgggtcttacaacatagaccttacagaggtctgatgccacatttgcactttgagcaaaaacacacagttactttaatcacccttgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctgtatggtagccaggaagacttgtttgtgctgggctggtagtaataaatgaggtacccccaggacaatttctgcacaatgaagttgtaccaatagagctccagaaaaatgtctcactcctcagacctttatttaaagatgggacaacaagcgtcttgacttctttccctttcctccttaggaaagacattcttccaagttgcttccctggaagatatttcgtcccagcaatccctctccagttccatgtgaccattcctactctgagccagttttggaaaggaaggtaagtggttggattaggttaggtgatatccaagtagaggtagccgaattccgtctaggactgggttaatgatgacaacccaatgtcatgaagaaaggtgatgacataaaattcatgctcaataggattacgctgaggcccaaccagggcgacagggtcacaagaggtccgttgactccttgaggggctctagggtgacttccctgaagtcctcagatgccctttccctgtttcccatgagaggaaatgtggacatctagggtgcacattggttggcaaacactgcatgccaacaagcacctattcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccaatcggtccttttggaattagggataacaaaatggtatacaacggtaccaaaggagctcgatttaggctatgttctccgatgtacatcccctggtttgtaacgttttaaggaatgtgttcaactcccgataattgttctttcataattttgacctacttctcatggagagaggagggtgacattttttgaatgttgggttctcatactttgatgcttacaattccatggcaaatagcttcaggaggacaacacaggcctccagggcctaatgggagtcttcctttcccttgacaggagaggcccaagtgacagaccctttcttagggaaaaagaaggattctatgatatcaaaaaaggctgtcctccccaggatgggttcacaaagggcaatccctctagcagacattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctccgtccaggattctcgggagattttcaggaatcacctttcacgttgagtcgggtcttacaacatagaccttacagaggtctgatgccacatttgcactttgagcaaaaacacacagttactttaatcaccctcgaaatacctatctgtagttgttttattcaattatgttttgtcctatccatagaacttgggcagctcaacttgagtgttgatacctacaaaattgtgaggctaaggtcacatgtgatgtggctgttgcttcgagaggaagcagtaaatctttattggaatgccagggttcctttgtgtagccactgatgattctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagtgtcttgacttctttccctttcctccttagggaagacattcttccaagtatcaagaaagggagcccttgattccctggaagacatttcgtcccagcattccctctccagttccatgtgaccattcctactctgagccagttttggaaaggaaggtaagtggttggattaggttaggtgatatccaagtagaggtagccgaattctgtcttggactgggtcaatgatgacaacccaatgtcatgaagaaaggtgatgacataaaattcatgctcaataggattacgctgaggcaaaaccagggcgacagggtcacaagagctccttgggggggctctagggtgacttccctgaagtcctcagatgcccttgccctgtttccgatgagaggaaatgtggacatctagggtgcacattggttggcaaacactgcatgccaacaagcacctagtcccacaatggaaccttaggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagccagtctgtccatttggaattagggataacaaaatggtatacaacggtaccaaaggagctcgatttaggctatgttctccgatgtacatcccctggtttgtaacgttttaaggaatgtgttcaactccggataattgttttttcataattttgacctacttctcatggagagaggaggatgacattttttgaatgttgggatctcagactttgatgcttacaattttatggcaaatagctacaggaggacaacactggcctccaggacgttatgggactcttcctttcttttgacaggggaggcccaagtgacagatcctttcttagggaaaaagaaggattctatgatatccaaaaaggctgtcctccccaggatgggtttacaaagggcaattcctctagcagatattccaaagatctcaccccagagaaaatttacccatgtggatagggtgagatattcatttttaccttggtgcccaccacattctaaatttccttcatggtatcatttagggcacttactgaacctcactgcagaatcactgaggaaaaaaagctctacacattaggttgatacagggtaatgccaggtgtttaaagaacctaattgcactttgattcataacaccaaggcctgacttgagtccagcaacaacggttaccctcacgttttacagcagggcaacccataacaccttgacacaaatggatccatgtatacacatgggttttgtggcttggggccaggattctcgggagattttcaggaatcacctttcacgttgagttgggtcttacaacatagaccttacagaggtctgatgccacatttgcactttgagcaaaaacacacagttactttaatcacccttgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatcttattggaatgccagggttcctttgtgggttccactgatgtttctgtatggtagccaggaagacttgtgtgtgctgggctggtagtaataaatgaggtaaccccaggacaatttctgcacaatgaagttgtaccagtagagctccagaaaaatgtctctctcctcaaacctttatttaaagatgggacaacaagcgtcttgtcttctttccctttcctccttaggaaagacattcttccaagttgcttccctggaagacatttcatcccagcaatccctctccagttccatgtgaccatttctactctgagccagttttggaaaggaaggtaagtggttggattaggttaggtgatatccaagtagaggtagccgaattctgtctaggactgggtcaatgatgacaacccaatgtcatgaagaaagttgatgacataaaattcatgctcaataggattacactgagccccaaccagggcgacagagtcacaagaggtccgttgactccttggggggctcttgggtgacttccctgaagtcctcagatgcccttgccctgtttcccatgagaggaaatgtggacatctagggtgcacattggttgacaaacactgcatgccaacaagcacctagtcccacaatagaaccttgggcatttctgcaaggatagccccttgctcatgacaatgtcttttctggtgttttgcagtcatctcacatgccaccttggaaggcagagaaacacagataatcaggtaagtggtcagaacatggtaaatcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattccatggcaaatagcttcaggaggacaacacaggcctccagggcctaatgggagtcttcctttcccttgaaaggagaggcccaagtgacagaccctttcttagggaaaaagaaggattctatgatatccaaaaaggttgtcctccccaggatgggttcacaaagggcaatccctctagcagatattccaaagatctcaccccagagacaatttaccaatgtggatagggtgagatattcatttttaccttggtacccaccacattccaaatttccttcttggtatcatttagggcacttactgaacctcactgcagaatcactgaggaaaaaaagctctacacattaggttgatacagggtaagaccaggtgtttaaagaacctaattccactttgattcataacaccaaggcctgactttagtccagtaacagtgcttactctcacggtttacagcagggcaacccataacacgttgacaaaaatggatacatgtatagacatgggttctgtggcctcggtccaggattctcgggagattttcaggaatcacctttcacgttgagtcgggtcgtacaacatagaccttacagaggtctgatgccacatttgcactttgagcaaaaacacacagttactttaatcaccctcgaaatacctatctgtagttgttttattcaattacttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggttgccaggaagacttgtgtgtgctgggctggtagtaatacaagatgtaaccccaggacagtttctgcacaatgaagttgtacaagtagagctccagaaaaatgtctctctcctctgacctttatttaaagaagggacaacaagcgtcttgacttctttccctttcctccttagggaagacattcttccaagtatcaagaaagggagcccttgcttccctggaagacatttcgtcccagcattccctctccagttccatgtgaccattcctactctgagccagttttggaaaggaaggtaagtggttggattaggttaggtgatatccaagtagaggtagccaaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgatttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtcagtggtcagaatatggtaaagcctccacatctaggtgaccttccttttcatgatttggctttcaattctcagccagtcggtccttttggaatcagggataacaaaatggtatacaacggtaccaaaggagctcgatttaggctatgttctcagatgtacatcccctggtttgtaacgttttaaggaatgtgttcaactcccgataattgttttttcataattttgacctatttctcatggagagaggaggatgacattttttgaatcttaggatctcatactttgatgcttacaattttatggcaaatagctacagtaggacaacacaggcctccagggacttatgggactcttcctttcccttaacaggggagtcccaagtgacagagcctttcttagggaaaaagaaggattctatgatatccaaaaagggtgtcctccccaggatgggttcacaaagggcaatccctctagcagatattctaaagatctcaccccagagacaatttacccatgtggaaagggtgaaatattcatttttaccttggtgcccaccacattccaaatttccttcatggtatcatttagggcacttactgaacctcacggcataatcactgaggaaaaaaagctctacacattaggttgatacagggtaaggccaggtgtttaaagaacctaattccactttgattcataacaccaaggcctgacttgagtccagcaacagtggttaccctcacgttttacagcagggcaacccatagcaccttgacacaaatggataaatgtgtagacatgggttctgtggcctgggcccaggattctcgggagattttcaggaatcacctttcacgttgagttggttcttacaacaaagaccttacagaggtctgatgccacatttgcactttgagcaaaaacacacacttactttaataccctcgaaatacctatctgtagttgttttattcaattaattttttgtcctatccatagaacttgggcagctcaacttgagtgttgatacctacaaaattttgaggctaaggtcacatgtgatgtggctgttgcttcaagaggaagcagtaaatctttattggaatgccagggttcctttgtgtggccactgatgtttctctattgtagccaggaagacttgtgtgtgctgggctggtagtaatacaagaggtaaccccaggacagtttctacacaatgaagttgtaccagtacagctccagaaaaatgtctccctcctctgacctttattaaagaagggacaaaaagcacctcaacttctttccctttcctccttagggaagacattcttccaagtatcaagagagggagcccttgcttcactggaagacatttcttcccagtaatcactctccagttccatgtgacctttcctaatctgagccagttttggaaaggaaggtaaatggttggattaggttaggtgatatccaagaagaggtagccgaattctgtctaggactgggtcaatgatgacaacacaatgtcatgaagaaaggtgatgacataaaattcatgctcaataggattatgctgaggcccaaccagggcaacagggtcatagaggtcggttgactttttggggggctcttgggtgatttccctgaagtcctcagatgcccttgccctgtttcccatgagaggaaatgtggacatctagggtgcacattggttggcaaacactgcatgccaacaagcacctagtcccaaaatggaacattgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccttggtttgaaacgttttaaggaatgtgttcaactcccgataattgtttttccataattttgtcctacttctcattgtgagaggagcatgacattttttgaatcttaggatctcatactttgatgcttacaattccatggcaaatagctacttgaggacaatacaggcctccagggccttatgggactcttcctttcccttgacaggggaggcccaagtgacagagtctttcttagggaaaaagaaggattctgtgatatccaaaaaggctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcattgaggaaaaaaagctctacacattaggttgatacagggtaaggccaggtgtttaaagaacctaattccactttgattcataacaccaaggcctgactttagtccagcaacagtgcttacaatcatggtttacagcagggcaacccataacacgttgacacaaatggatatatgtatagacatgggttctgtggcctcggtccaggattctcgggagattttcaggaatcacctttcacgttgagttgggtcgtacaacatagactttacagaggtctgatgccacatttgcactttgagcaaaaacacacagttactttaatcaccctcgaaatacctatctgtagttgttttattcaattacttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctggtctggtagtaatacaagaggtaaccccaggacagtttctgcacaatgaagttgtacaagtagagctccagaaaaatgtctctctcctctgacctttatttaaagaagggacaacaagcgccttgaattctttcccattcctccttagggaagacattcttccaagtatcaagaaagggagcccttgcttccctggaagacatttcgtcccagtaatcactctccagttccatgtgaccattcctactctgagccagttttggacaggaaggtaagtggttggattaggttaggtgatatctaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctaagccagtctgtccttttggaatttggggataacaaaatggtatgcaaaggttccaaaggagcctgatttaagctatgttctccgatgtacatcccctggtttataacgttttaaggaatgtgttcaactcccgataattgctttttcataattttgacctacttctcattgagagaggagcatgacattttttgaatcttaggttctcatactttgatgcttacaattttatggccaatagctacagtaggacaacacaggcctccagggaattatgggactcttcctttcccttaacaggggagtcccaagtgacagagcctttcttagggaaaaaaaaggattctatgatatccaaaaagggtgtcctcccaagatgggttcacaaagggcaatccctctagcagatattctaaagatctcaccccagagacaatttacccatgtggaaagggtgagatataaatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacaatcatgttttacagcaaggcaaccataacacgttgacacaaatggatacatgaatagacatgggttctgtggcctcggtccaggattctcgggagattttcaggaatcacctttcacgttgaatcggatcctacaacatagaccttacagaggtctgatgccacatttgcactttgagcaaaaacacacagttactttaatcgccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttatgtgtgctgggctggtagtaatacaagaggtaaccccaggacagtttctgcacaatgaagttgtacaagtagagctccagaaaaatgtctctttcctctgacctttatttaaagaagggacaacaagcgccttgacttctttccctttcctccttagggaagacattcttccaagtatcaagaaagggaacccttgcttccctggaagacatttcgtcccagcaatccctctacagttccatgtgaccattcctactctgagccagttttggaaaggaaggtaagtggttagattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttgacaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagcaagtcggtccttttggaatttggggataacaaaatggtatgcaaaggttccaaaggagctcgatttaagctatgttctccgatgtacatcccctggtttataacgttttaaggaatgtgttcaactccagataattgctttttcataattttgacctacttctcattgagagaggagcatgacattttttgaatcttaggatctcatactttgatgcttacaattttatggccaatagctacagtaggacaacacaggcctccagggaattatgggactcttcctttcccttaacaggggagtcccaagtgacagagcctttcatagggaaaaagaaggattctatgatatccaaaaagggtgtcctccccaggatgggttcacaaagggcaatccctctagcagatattctaaagatctcaccccagagacaatttacccatgtggaaagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacaatcacgttttacagcagggcaacccataacacgttgacgcaaatggatatatgtatagacatgggttctgtggcctcggtccaggattctcgggagattttcaggaatcacctttcacgttgagtcgggtcgtacaacatagaccttacagaggtctgatgccacatttgcactttgagcaaaaacacacagttactttaatcaccctcgaaatacctatctgtagttgttttattcaattaatttttgtcctatccatagaacttgggcagctcaacttgagtgttgatacctacaaaatggtgaggctaaggtcacctgtgatgtggctgttgcttcgagaggaagcagtaaatctttattggaattccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagcgccttgacttctttccctttcctccttagggaagacattcttccaagtatcaagaaagggagcccttgcttccctggaagacatttcgtcccagcaatccctctccaggtccatgtgaccattcctactctgagccagttttggaaaggaaggtaattagttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttgacaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagccagtctgtccttttggaatttggggataacaaaatggtatgcaaaggttccaaaggagctcgatttaagctatgttctccgatgtacatcccctggtttataacgttttaaggaatgtgttcaactccatataattgctttttcataattttgacctacttctcattgagagaggagcatgacattttttgaatcttaggatctcatactttgatgcttacaattttatggccaatagctacagtaggacaacacaggcctccagggacttatgggactcttcctttcccttaacaggggagtcccaagtgacagagcctttcatagggaaaaagaaggattctatgatatccaaaaagggtgtcctccccaggatgggttcacaaagggcaatccctctagcagatattctaaagatctcaccccagagacaatttacccatgtggaaagggtgagatattcatttttaccttggtacccaccacattccaaatttccttcatggtatcatttagggcacttactgaacctcactgcagaatcactgaggaaaaaaagctctacacattaggtagatacagggtaaggccaggtgtttaaagaacctaattccactttgattcataacaccaaggcctgactttagtccagcaacagtgcttacaatcacgttttacagcagggcaacccataacacgttgacgcaaatggatatatgtatagacatgggttctgtggcctcggtccaggattctcgggagattttcaggaatcacctttcacgttgagtcgggtcgtacaacatagaccttacagaggtctgatgccacatttgcactttgagcaaaaacacacagttactttaatcaccctcgaaatacctatctgtagttgttttattcaattaatttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagcgccttgacttctttccctttcctccttagggaagacattcttccaagtatcaagaaagggagcccttgcttccctggaagacatttcgtcccagcaatccctctccaggtccatgtgaccattcctactctgagccagttttggaaaggaaggtaattagttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttgacaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagccagtctgtccttttggaatttggggataacaaaatggtatgcaaaggttccaaaggagctcgatttaagctatgttctccgatgtacatcccctggtttataacgttttaaggaatgtgttcaactccatataattgctttttcataattttgacctacttctcattgagagaggagcatgacattttttgaatcttaggatctcatactttgatgcttacaattttatggccaatagctacagtaggacaacacaggcctccagggacttatgggactcttcctttcccttaacaggggagtcccaagtgacagagcctttcatagggaaaaagaaggattctatgatatccaaaaagggtgtcctccccaggatgggttcacaaagggcaatccctctagcagatattctaaagatctcaccccagagacaatttacccatgtggaaagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacaatcatgttttacagcagggcaacccataacaccttgacacaaatggatataagtatagacatgggttctgtggcctcggtccaggattctcgggagattttcaggaatcacctttcacgttgagtcgggtcgtacaacatagaccttacagaggtctgatgccacatttgcactttgagcaaaaacacacagttactttaatcaccctcgaaatacctatctgtagttgtgttattcaattattttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaaatgtctccctcctctgacctttattaaagaagggacaaaaagcgcctcgacttctttccctttcctccgtagggaagacattcttccaagtatcaagaaagggagcccttgcttcactggaagacatttcgtcccagtaatcactctccagttccatgtgacctttcctaatctgagccagttttggaaaggaaggtaaatggttggattaggttaggtgatatccaagtagaggtagccgaattctgtctagaactgggtcaatgatgacaacccaatgtcatgaagaaaggtgatgacataaaattcatgctcaataggattacgctgaggcccaaccagggcgacagggtcacaagagctccgttgactccttcgggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaatatggtaaagcctccacatcaaggtgccctcccccttcatgatttagctttcaattctcagccagtctgtccttttggaattttgggataacaaaatggtatgcaacagtaccaaaggagctcgatttaggctatgttctcagatgtacatcccctggtttgaaacgttttaaggaatgtgttcaactcccgataattttttttccataattttgtcctacttctcattgtgagaggagcatgacattttttgaatcttaggatcttatactttgatgcttacaattcaatggcaaatagctacaggaggacaatacaggcctccagggtcttatgggactcttcctttcccttgacaggggaggcccatgtgacaaagtcttttttagggaaaaagaaggattctgtgatatccaaaaaggctgtcctccccaggatgggttcacaaagggcaatccctctagcagatattccaaagatctcaccccagagacaatttacccgtgtggaaagggttagatattcatttttaccttggtgcccaccacattccaaatttccttcatggtattatttagggcacttactgaacctcactgcagaatcactgaggaaaaaaagctctacacattaggtagatacagggtaaggccaggtgtttaaagaacctaattccactttgatttataacaccaaggcctgattgagtccagcaacagtggttaccctcacattttacagcagggcaacccataactccttgacacaaatggatccatgtatagtcatgggttctgtggcctgggcccaggattctcgggagattttcaggaatcagcttttacgttgagtcgggccgtacaacatagaccttacagaggtctgatgccacatttgcacgttgagcaaaaacacacaatttctttaatcaacctcgaattacctatctgtagttgttttattcaattatttttttgtcctatccatagaatttgggcagctcaacttgagtgttgatacctacaaaattgtgaggctaaggtcacatgtgatgtggctgttgcttcgagaggaagcagtaaatctttattcgaatgccaggtttcctttgtgtgtccactgatgtttctctatggtagcagggaagacttgtgtgtgctgggcaggtagtaatacaacagataaccccaggacagtttctgcacaatgaagttgtgccagtagagctccagagaaaagtctctctcctctgacctttatttaaagaagggacaacaagcgccttgacttttttccctttcctccttagggaagaccttcttcaaagtatcaagaaagggagcccttgcttccctggaagacatttcgtcccagcaatccctctccagttaaatgttaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctatccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaggatggaccatgtagagactgccatatccagggatccaccccaaaatcagcatccaaacgctgacaccattgcatatactagcaagattttatcgaaaggacccagatgtagctgtctcttgtgagactatgccggggcttagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaggaaaaaaaaaaataaaaattttctctaaaacaataaaaaaaaaaaaaaaaaattcattctcaataggattacgctgaggcccaaccagtgcgacagggttacaagagatccattgactttttggggagctcttgggtcacttccctgaagtcctcagatgcccttgccctgtttcccatgagaggaaatttggacatctagggtgcacattggttggcaaacactgcatgccaacaagcacctagtcccacaatggaaccttgggcatttctgcaagaatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtctgtccttttggaattagggataacaaaatggtatgcaacggtaccaaaggagctctatttaggctatgttctccgatgtacatcccctggtttgtaacggtttaaggaatgtgttcaactcccgacaaatgttttttcataattttgacctacttctcaaggagagaggaggatgacgttttttgaatattggcatctcatactgtgatgcttacaattccatggcaaatagctacaggaggacaacacaggcctccagggccttatgggactcttcctttcccttgacaggggaggcccaagtgacagagcctttcttagggaaaaaaaaaggattctatgatatccaaaaaggctgtcctccccaggatgggttcacaaagggcaatgcctctagcagatattccaaagatctcaccccagagacaatttacccatgtggaaagggtgagatattaatttttaccttggtgcccaccacattccaaatttccttcatggtatcatttggggtacttactgaacctcactgcagaatcactgaggaaaaaaagctctacacattaggttgatacaaggtaaggccaggtgtttaaagaacctaattgcatttgattcataacaccaaggcctgacttgagtccagcaacagtggttaccctcaagttttacagcagggcaacccataacaccttgaaacaaatggatccatatatagacatgggttctgtggcctggtcccaggattctcgggagattttcaggaatcacctttcacgttgagtcgggtattacaacatagaccttacagaggtctgatgccacatttgcactttgagcaaaaacacacagttactttaatcaccctcgaaatacctatctgtagttgtttaattcaataatttttttgtcctatccatatgacttggacagctcaacttgagtgttgatacctacaaaattgtgaggctaaggtcacatgtgatgtggctgttgcttcgagaggaagcagtaaatctttattggaatgccagggatcctttgtgtgtccactaatgtttctctatggtagccaggaagacttgtgtgtgctgggctggtagtagtacaagaggtaaccccagaacagtttctgcacaatgaagttgtgctagtagagctccagaaaaatgtctctctcctctgacctttatttaaagaagggacaacaagcgccttgacttctttccctttcctccttagggaagacattcttccaagtatcaagaaagggagcccttgcttccctggaagacatttcatcccagcaatccctctccagttccatgtgaccattcctactctgagccagttttggaaaggaaggtaagtggctggattaggttaggtgatatccaagtagaggtagccgaattctgtctaggactgggtcaatgatgacaacccaatgtcatgaagaacggtgatgacataaaattcatgctcaataggattacgctgaggcccaactagggcgacagggtcacgagaggtccattgactctttggggggctcttgggtgacttccctgaagtcctgagatgcccttaccctgtttcccatgagaggaaatgtggacatctagggtgcacattggttggcaaacactgcatgccaacaaacacctagtcccacaatggaaccttgggcatttctgcaaggatcgccccttgctcatgacaatgtcttttctggtgttttgcagtcatctcacatgccaccttggaaggccgagaaacacagataatcaggtaagtggtcagaacatggtaaagcctccacatccaggtgacctcccccttcatgatttggctttcaattctcagccagtctgtttttttggaaatagggataacaaaatggtatgcaacggtaccaaaggagctcgatttaggctatgttctccgatgtacatcccctggtttgtaacggtttaaggaatgtgttcaactcctgacaattgttttttcataattttaacctacttctcaaggagagaggaggatgacattttttgaatattggcatctcatactgtgatgcttacaattccatggcaaatagctacaggaggacaacacaggcctccagggccttatgggactcttcctttcccttgacaggggaggcccaagtgacagagcctttcttagggaaaaaaaaggattctatgatatccaaaaaggctgtcctccccagggtgggttcacaaagggcaatgcctctagcagatattccaaagatctcaccccagagacaatttacccatgtggaaagggtgagatattaatttttaccttggtgcccaccacattccaaatttccttcatggtatcatttggggtacttactgaacctcactgcagaatcactgaggaaaaaacgctctacacattaggttgatacagggtaaggccaggtgtttaaacaacctaattccactttaattcataacaccaaggcctgacttgagtccagcaacagtggctaccctcaagttttacagcagggcaacccataacaccttgaaacaaatggatccatgtatagacatgggttctgtggcctgggcccaggactctcgggagattttcaggaatcacctttcacgttgagtcgggccttacaacatagaccttacagaggtctgatgccacatttgcactttgaacaaaaacacacagttactttaatcaccctcgaaatacctatctgtagttgtttaattcaataatttttttgtcctatccatatgacttggacagctcaacttgagtgttgatacctacaaaattgtgaggctaaggtcacatgtgatgtggctgttgcttcgagaggaagcagtaaatctttattggaatgccagggttcctttgtgtgtccactgatgtttctctatggtagccaggaagacttgtgtgtgctgggctggtagtagtacaagaggtaaccccaggacagtttctgcacaatgaagttgtgccagtagagctccagaaaaatgtctctctcctctgacctttatttaaagaagggacaacaagcgccttgacttctttccctttcctccttagggaagacattcttctaagtatcaagaaagggagcccttgcttccctggaagacatttcatcccagcaatccctctccagttccatgtgaccattcctactctgagccagttttggaaaggaaggtaagtggctggattaggttaggtgatatccaagtagaggtagccggattctgtctaggactgggtcaatgatgacaacccaatgtcatgaagaacggtgatgacataaaatacatgctcaataggattacgctgaggccaaaccagggcgacagagtcacaagaggtccgttgactccttggggggctcttgggtgacttccctgaagtcctcagatgctcttgccctgtttcccatgagaggaaatatggatatctagggtgcacattatggcaaacactgcatgccaacaagcaactagtcccacaatggaaccttgggcatttctgcaaggatcgcaccttgctcatgacaatgtcttttctggtgttttgcaatcatctcacatgccaccttggaaggcagagaaacacagataatcaggtaagtggtcagaacatggtaaagcctccacatccaggtgacctcccccttcatgatttggctttcaattctcagacagtctgtccttttggaattagggataacaaaatggtatgcaacggtaccaaaggagcttgatagaggctatgttttccgaagtacattccctggtttgtaacattttaaggaatgtgttcaactcccgacaattgttttttcataattttgacctacttctcattgagagaggaggatgacattttttgaatattggcacctcatactttgatgcttacaattccattggaaatagcttcaggaggacaacacaggcctccagggccttatgggactcttcctttcccttgacaggggaggcccaagagacagagcgtttcttagggaaaaagaaggattctatgatatccaaaaaggctgtcctccccaggatgggttcacaaagggcaatccctctagcagttattccaaagatctcacctcagagacaatttacccatgtggaaagggtgaaatattcatttttaccttggtgcccaccacattccaaatttccttcatggtgtcatttagggcaattactgaacctcactgcaaaatcactgaagaaaaaaagctctacacattagtttgatacagggtaaggccaggtgtttaaagaacgaaattccactttgattcataacaccaaggcctgacttgagtccagcaacagtggctaccctcaagttttacagcatggcaacccataacaccttgacacaaatggacccatgtatagacatgggttctgtggcctgggccaggattctcgggagattttcaggaatcacctgtcaagttgagtcgggccttacaacatagaccttacagagttctgatgccacatttgcactttgagcaaaaacacacagttactttaatcaccctcgaaatacctatctgtagttgttttattcaattatttttttgtcctatccatagaacttgggcagctcaacttgagtgttgatactacaaaattgtgaggctaaggtcacatgtgatgtggttgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaaaatgtctctctcctctgacctttatttaaagaagggacaacaagtgccttgacttctttccctttcctccttagggaagacattcttccaagtatcaagaaagagagcccttgcttccctggaagacatttcgtcccagcaatcactctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattaccctgaggcccaaccagggtgacagggttacaagaggtccattgactccttggggggctcttgggtgacttccctgaagtcctcagatgcccttgccctgtttcccatgagaggaaatgtggacatctagggtgcacattggttggcaaacactgcatgccaacaggcacctagtcccacaatggaaccttgggcatttctgcaaggatcgcaccttgctcatgacaatgtcttttctgttgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaattgtatgcaaaggtaccaaaggagctcgatttaggctatgttctccgatgtacatcccctggtttgtaacattttaaggaatgtgttcaactccctataattgttttttcataattttgacctacttatcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctatgatatccaaaaaggctgtcctccccaggatgggttcataaagggcaatcactctagcagatattccaaagatctcaccccagagacaatttacccatgtggaaagggtgagatattaatttttaccttggtgcccaccacattccaaatttccttcattttatcatttggggcacttactgaacctcactgcagaatcactgaggaaaaaaagctctacacattagtttgatacagggtaaggccaggtgtttaaagaacctaattccactttgattcataacaccaagccctgacttgagtccagcaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgagcagctcatcttgagtgttgatacctacaaaattgtgaggctaaggtcacaagggatgtggctgttgcttcgagaggaagcagtaaatctttattggaattccagggatcctttgcgtgccctctgatgtttctgtatggtagccaggaagacttgtgtgtgctgggctggtagtaatacaagaggtaaccccaggacagtttctgcacaatgaacttgtgccagtagagctccagaaaaatgtctctctcctctgacctttatttaaagaagggacaacaagcgccttgacttctttccctttcctccatagggaagacattcttccaagtatcaagaaagggagcccttgcttccatggaagatatttcctcccaacaatccctctccagttcaatgtgaccattcctactctgagccagttttggaaaggaaggtaagttgttggattaggttaggtgatatccaagtaggggtagccgaattctgtctaggactgggtcaatgatgacaacccaatgtcatgaagaaagttgatgacataaaattcatgctcaataggattacactgagccccaaccagggcgacagagtcacaagaggtccgttgactccttggggggctcttgggtgacttccctgaagtcctcagatgctcttgccctgtttcccatgagaggaaatatggatatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagacagtctgtccttttggaattagggataacaaaatggtatgcaacggtaccaaaggagcttgatagaggctatgttttccgaagtacatcccctggtttgtaacattttaaggaatttgttcaactcccgacaattgttttttcataattttgacctacatctcattgagagaggaggatgacatttttgaatattggcacctcatactttgatgcttacaattccactggaaatagcttcaggaggacaacactggcctccagggccttatgggtctcttcctttcccttgacaggggaggcccaagagacagagcgtttcttagggcaaaaaaaggattctatgatatccaaaaaggctgtcctccccaggatgggttcataaagggcactccctctagcagttattccaaagatctcaccccagagacaatttacccatgtcgaaagggtgaaatattcatttttaccttggtgcccaccacattccaaatttccttcatggtgtcatttagggcacttactgaacctcactgcagaatcactgaggaaaaaaagctctacacattagtttgatacagggtaaggccaggtgtttaaagaacgaaattccactttgattcataacaccaaggcctgacttgagtccagcaacagtggttaccctcacgttttacagcatggcaacccataacaccttgacacaaatggacccatgtatagacatgggttctgtggcctgggccagatttctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaactttgtgaggctaaggtcacctgtgatgtggctgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagagagggagcccttgcttccctggaagacatttcgtcccagcaatcactctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttcgctttcaattctcggccagtcggtccttttggaatttggggataacaaaatggtatgcaaaggtaccaaaggagctcgatttaggctatgttctccgatgtacatcccctggtttgtaacgatttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctatgatatccaaaaaggctgtcctccccaggatgggttcataaagggcaatcactctagcagatattccaaagatctcaccccagagacaatttacccatgtggaaagggtgagatattaatttttaccttggtgcccaccacattccaaatttccttcatggtatcatttggggcacttactgaacctcactgcagaatcactgaggaaaaaaagctctacacattagtttgatacagggtaaggccaggtgtttaaagaacctaattccactttgattcataacaccaagccctgacttgagtccaggaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaactttgtgaggctaaggtcacatgtgatgtggctgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagagagggagcccttgcttccctggaagacatttcgtcccagcaatcactctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttcgctttcaattctcggccagtcggtccttttggaatttggggataacaaaatggtatgcaaaggtaccaaaggagctcgatttaggctatgttctccgatgtacatcccctggtttgtaacgttttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcgtagggcaaaaaaaggattctatgatatccaaaaaggctgtcctccccaggatgggttcataaagggcaatcactctagcagatattccaaagatctcaccccagagacaatttacccatgtggaaagggtgagatattaatttttaccttggtgcccaccacattccaaatttccttcatggtatcatttggggcacttactgaacctcactgcagaatcactgaggaaaaaaagctctacacattagtttgatacagggtaaggccaggtgtttaaagaacctaattccactttgattcataacaccaagccctgacttgagtccagcaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgagcagctcatcttgagtgttgatacctacaaaattgtgaggctaaggtcacaagggatgtggctgttgcttcgagaggaagcagtaaatctttattggaattccagggatcctttgcgtgccctctgatgtttctgtatggtagccaggaagacttgtgtgtgctgggctggtagtaatacaagaggtaaccccaggacagtttctgcacaatgaacttgtgccagtagagctccagaaaaatgtctctctcctctgacctttatttaaagaagggacaacaagcgccttgacttctttccctttcctccatagggaagacattcttccaagtatcaagaaagggagcccttgcttccatggaagatatttcctaccaacaatccctctccagttccatgtgaccattcctactctgagccagttttggaaaggaaggtaagttgttggattaggttaggtgatatccaagtagaggtagccgaattctgtctaggactgggtcaatgatgacaacccaatgtcatgaagaaagttgatgacataaaattcatgctcaataggattacactgagccccaaccagggcgacagagtcacaagaggtccgttgactccttggggggctcttgggtgacttccctgaagtcctcagatgctcttgccctgtttcccatgagaggaaatatggatatctagggtgcacattggttggcaaacactgcatgccaacaagcacctagtcccacaatggaaccttgggcatttctgcaaggatcgcaccttgctcatgacaatgtcttttctggtgttttgcaatcatctcacatgccaccttggaaggcagagaaacacagataatcaggtaagtggtcagaacatggtaaagcctccacatccaggtgacctcccccttcatgatttggctttcaattctcagacagtctgtccttttggaattagggataacaaaatggtatgcaacggtaccaaaggagcttgatagaggctatgttttccgaagtacatcccctggtttgtaacattttaaggaatttgttcaactcccgacaattgttttttcataattttgacctacatctcattgagagaggaggatgacatttttgaatattggcacctcatactttgatgcttacaattccactggaaatagcttcaggaggacaacactggcctccagggccttatgggtctcttcctttcccttgacaggggaggcccaagagacagagcgtttcttagggcaaaaaaaggattctatgatatccaaaaaggctgtcctccccaggatgggttcataaagggcactccctctagcagttattccaaagatctcaccccagagacaatttacccatgtcgaaagggtgaaatattcatttttaccttggtgcccaccacattccaaatttccttcatggtgtcatttagggcacttactgaacctcactgcagaatcactgaggaaaaaaagctctacacattagtttgatacagggtaaggccaggtgtttaaagaacgaaattccactttgattcataacaccaaggcctgatttgaatccagcaacagtggttaccctcacgttttacagcatggcaacccataacaccttgacacaaatggacccatgtatagacatgggttctgtggcctgggccagatttctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaactttgtgaggctaaggtcacctgtgatgtggctgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagagagggagcccttgcttccctggaagacatttcgtcccagcaatcactctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttcgctttcaattctcggccagtcggtccttttggaatttggggataacaaaatggtatgcaaaggtaccaaaggagctcgatttaggctatgttctccgatgtacatcccctggtttgtaacgatttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctatgatatccaaaaaggctgtcctccccaggatgggttcataaagggcaatcactctagcagatattccaaagatctcaccccagagacaatttacccatgtggaaagggtgagatattaatttttaccttggtgcccaccacattccaaatttccttcatggtatcatttggggcacttactgaacctcactgcagaatcactgaggaaaaaaagctctacacattagtttgatacagggtaaggccaggtgtttaaagaacctaattccactttgattcataacaccaagccctgacttgagtccaggaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaactttgtgaggctaaggtcacatgtgatgtggctgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagagagggagcccttgcttccctggaagacatttcgtcccagcaatcactctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttcgctttcaattctcggccagtcggtccttttggaatttggggataacaaaatggtatgcaaaggtaccaaaggagctcgatttaggctatgttctccgatgtacatcccctggtttgtaacgttttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcgtagggcaaaaaaaggattctatgatatccaaaaaggctgtcctccccaggatgggttcataaagggcaatcactctagcagatattccaaagatctcaccccagagacaatttacccatgtggaaagggtgagatattaatttttaccttggtgcccaccacattccaaatttccttcatggtatcatttggggcacttactgaacctcactgcagaatcactgaggaaaaaaagctctacacattagtttgatacagggtaaggccaggtgtttaaagaacctaattccactttgattcataacaccaagccctgacttgagtccagcaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgagcagctcatcttgagtgttgatacctacaaaattgtgaggctaaggtcacaagggatgtggctgttgcttcgagaggaagcagtaaatctttattggaattccagggatcctttgcgtgccctctgatgtttctgtatggtagccaggaagacttgtgtgtgctgggctggtagtaatacaagaggtaaccccaggacagtttctgcacaatgaacttgtgccagtagagctccagaaaaatgtctctctcctctgacctttatttaaagaagggacaacaagcgccttgacttctttccctttcctccatagggaagacattcttccaagtatcaagaaagggagcccttgcttccatggaagatatttcctaccaacaatccctctccagttccatgtgaccattcctactctgagccagttttggaaaggaaggtaagttgttggattaggttaggtgatatccaagtagaggtagccgaattctgtctaggactgggtcaatgatgacaacccaatgtcatgaagaaagttgatgacataaaattcatgctcaataggattacactgagccccaaccagggcgacagagtcacaagaggtccgttgactccttggggggctcttgggtgacttccctgaagtcctcagatgctcttgccctgtttcccatgagaggaaatatggatatctagggtgcacattggttggcaaacactgcatgccaacaagcacctagtcccacaatggaaccttgggcatttctgcaaggatcgcaccttgctcatgacaatgtcttttctggtgttttgcaatcatctcacatgccaccttggaaggcagagaaacacagataatcaggtaagtggtcagaacatggtaaagcctccacatccaggtgacctcccccttcatgatttggctttcaattctcagccagtctgtccttttggaattagggataacaaaatggtatgcaacggtaccaaaggagcttgatagaggctatgttttccgaagtacatcccctggtttgtaacattttaaggaatgggttcaactcccgacaattgttttttcataattttgacctacttctcattgagagaggaggatgacattttttgaatattggcacctcatactttgatgcttacaattccattggaaatagcttcaggaggacaacacaggcctccagggccttatgggactcttcctttcccttgacaggggaggcccaagagacagagcgtttcttagggaaaaagaaggattctatgatatccaaaaaggctgtcctccccaggatgggttcacaaagggcaatccctctagcagttattccaaagatctcacctcagagacaatttacccatgtggaaagggtgaaatattcatttttaccttggtgcccaccacattccaaatttccttcatggtgtcatttagggcagttactgaacctcactgcaaaatcactgaagaaaaaaagctctacacattagtttgatacagggtaaggccaggtgtttaaagaacgaaattccactttgattcataacaccaaggcctgacttgagtccagcaacagtggttaccctcacgttttacagcatggcaacccataacaccttgacacaaatggacccatgtatagacatgggttctgtggcctgggccaggattctcgggagattttcaggaatcacctgtcaagttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaactttgtgaggctaaggtcacatgtgatgtggctgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagagagggagcccttgcttccctggaagacatttcgtcccagcaatccctctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgcttaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctgttgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctttgatatccaaaaaggctgtcctccccaggatgggttcataaagggcaatccctctagcagatattccaaagatctcaccccagagacaatttacccatgtggaaagggtgagatattcatttttaccttggtgcccaccacattccaaatttccttcatggtatcatttggggcacttactgaacctcactgcagaatcactgaggaaaaaaacctctacacattaggttgatacggggtaaggccaggtgtttaaagaacctaattccactttgattcataacaccaagccctgacttgagtccagcaacagaggttactctcaagttttacagcagggcaacccataacaccttgacaaaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgagcagctcatcttgagtgttgatacctacaaaattgtgaggctaaggtcacaagggatgtggctgttgcttcgagaggaagcagtaaatctttattggaattccagggatcctttgcgtgccctctgatgtttctgtatggtagccaggaagacttgtgtgtgctgggctggtagtaatacaagaggtaaccccaggacagtttctgcacaatgaacttgtgccagtagagctccagaaaaatgtctctctcctctgacctttatttaaagaagggacaacaagcgccttgacttctttccctttcctccttagggaagacattcttccaagtatcaagaaagggagctcttgcttccatggaagatatttcctcccaacaatccctctccagttccatgtgaccattcctactctgagccagttctggaaaggaaggtaagtggttggattaggttaggtgatatccaagtagaggtagccgaattctgtctaggactgggtcaatgatgacaacccaatgtcatgaagaaagttgatgacataaaattcatgctcaataggattacgctgaggcccaaccagggcgacagagtcacaagaggtccgttgactccttggggggctcttgggtgacttccctgaagtcctcagatgctcttgccctgtttcccatgagaggaaatatagatatctagggtgcacattggttggcaaacactgcatgccaacaagcacctagtcccacaatggaaccttgggcatttctgcaaggatcgcaccttgctcatgacaatgtcttttctggtgttttgcaatcatctcacatgccaccttggaaggcagagaaacacagataatcaggtaagtggtcagaacatggtaaagcctccacatccaggtgacttcccccttcatgatttggctttcaattctcagccagtctgtccttttggaattagggataacaaaatggtatgcaacggtaccaaaggagcttgatagaggctatgttttccgaagtacatcccctggtttgtaacattttaaggaatgggttcaactcccgacaattgttttttcataattttgacctacttctcattgagagaggaggatgacattttttgaatattggcacctcatactttgatgcttacaattccattggaaatagcttcaggaggacaacacaggcctccagagccttatgggactcttcctttcccttgacaggggaggcccaagtgatagagcctttcttagggaaaaaaaaggattctatgatatccaaaaaggctgtcctccccaggatgggttcacaaagggcaatccctctagaagttattccaaaaatctcacctcagagacaatttacccatgtggaaagggtgaaatattcatttttaccttggtgcccaccacattccaaatttccttcatggtgtcatttagggcaattactgaacctcactgcaaaatcactgaagaaaaaaagctctacacattagtttgatacagggtaaggccaggtgtttaaagaacgaaattccactttgattcataacaccaaggcctgacttgagtccagcaacagtggttaccctcacgttttacagcatggcaacccataacaccttgacacaaatggacccatgtatagacatgggttctgtggcctgggccaggattctcgggagattttcaggaatcacctgtcaagttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaaaattgtgaggctaaagtcacatgtgatgtggctgttgtttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagaaagggagcccttgcttccctggaagacatttcgtcccagcaatcactctccaggtccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccccaatggaaccttgggcatttctgcaaggatcgcaccttgctcatgacaatgtcttttctgttgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctatgatatccaaaaaggctgtcctccccaggatgggttcataaagggcaatccctctagcagatgttccaaagatctcaccccagagacaatttacccatgtggaaagggtgagatattaatttttacattggtgcccaccacattccaaatttccttcatggtatcatttggggcacttactgaacctcactgcagaatcactgaggaaaaaaagctctacacattaggttgatacggggtaaggccaggtgtttaaagaacctaattccactttgattcataacaccaagccctgacttgagtccagcaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagtggttttattcaattattttttgtcctatccatagaacttgagcagctcatcttgagtgttgatacctacaaaattgtgaggctaaggtcactagggatgtggctgttgcttcgagaggaagcagtaaatctttattggaattccagggatcctttgcgtgccctctgatgtttctgtatggtagccaggaagacttgagtgtgctgggctggtagtaatacaagaggtaaccccaggacagtttctccacaatgaagttgtgccaatagagctccagaaaaatgtctctctcctctgacctttatttaaagaagggacaacaagcgccttgacttctttccctttcctccttagggaagacattcttccaagtatcaagaaagggagctcttgcttccatggaagatatttcctcccaacaatccctctccagttccatgtgaccattcctactctgagccagttctggaaaggaaggtaagtggttggattaggttaggtgatatccaagtagaggtagccaaattctgtctaggactgggtcaatgatgacaacccaatgtcatgaagaaagttgatgacataaaattcatgctcaataggattacgctgaggcccaaccagggcgacagagtcacaagaggtccgttgactccttggggggctcttgggtgacttccctgaagtcctcagatgctcttgccctgtttcccatgagaggaaatatggatatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaagataccaaaggagctcgatttaggctatgttctccgatgtacatcccctggtttgtaacgttttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctatgatatccaaaaaggctgtcctccccaggatgggttcataaagggaaatccctctagcagatgttccaaagatctcaccccagagacaatttacccatgtggaaagggtgagatattaatttttacattggtgcccaccacattccaaatttccttcatggtatcatttggggcacttactgaacctcactgcagaatcactgaggaaaaaaagctctacacattaggttgatacggggtaaggccaggtgtttaaagaacctaattccactttgattcataacaccaagccctgacttgagtccagcaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagtggttttattcaattattttttgtcctatccatagaacttgagcagctcatcttgagtgttgatacctacaaaattgtgaggctaaggtcactagggatgtggctgttgcttcgagaggaagcagtaaatctttattggaattccagggatcctttgcgtgccctctgatgtttctgtatggtagccaggaagacttgagtgtgctgggctggtagtaatacaagaggtaaccccaggacagtttctccacaatgaagttgtgccaatagagctccagaaaaatgtctctctcctctgacctttatttaaagaagggacaacaagcgccttgacttctttccctttcctccttagggaagacattcttccaagtatcaagaaagggagctcttgcttccatggaagatatttcctcccaacaatccctctccagttccatgtgaccattcctactctgagccagttctggaaaggaaggtaagtggttggattaggttaggtgatatccaagtagaggtagccaaattctgtctaggactgggtcaatgatgacaacccaatgtcatgaagaaagttgatgacataaaattcatgctcaataggattacgctgaggcccaaccagggcgacagagtcacaagaggtccgttgactccttggggggctcttgggtgacttccctgaagtcctcagatgctcttgccctgtttcccatgagaggaaatatggatatctagggtgcacattggttggcaaacactgcatgccaacaagcacctagtcccacaatggaaccttgggcatttctgcaaggatcgcaccttgctcatgacaatgtcttttctggtgttttgcaatcatctcacatgccaccttggaaggcagagaaacacagataatcaggtaagtggtcagaacatggtaaagcctccacatccaggtgacctcccccttcatgatttggctttcaattctcagccagtctgtccttttggaattagggataacaaaatggtatgcaacggtaccaaaggagcttgatagaggctatgttttccgaagtacatcccctggtttgtaacattttaaggaatgggttcaactcccgacaattgttttttcataattttgacctacttctcattgagagaggaggatgacattttttgaatattggcacctcatactttgatgcttacaattccattggaaatagcttcaggaggacaacacaggcctccagagccttatgggactcttcctttcccttgacaggggaggcccaagagacagagcatttcttagggaaaaagaaggattctatgatatccaaaaaggctgtcctccccaggatgggttcacaaagggcactccctctagcagttattccaaaaatctcacctcagagacaatttacccatgtggaaagggtgaaatattcatttttaccttggtgcccaccacattccaaatttccttcatggtgtcatttagggcaattactgaacctcactgcaaaatcactgaagaaaaaaagctctacacattagtttgatacagggtaaggccaggtgtttaaagaacgaaattccactttgattcataacaccaaggcctgacttgagtccagcaacagtggttaccctcacgttttacagcatggcaacccataacaccttgacacaaatggacccatgtatagacatgggttctgtggcctgggccaggattctcgggagattttcaggaatcacctgtcaagttgagtcgggccttacaacatacaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaaaattgtgaggctaaggtcacatgtgatgtggctgttgcttcgagaggaagcagtaaatctttattggaattccagggttcctttgtgtgtccactgatgtttctatatggtagccaggaaaacttgtgtgtgctgggctgatagtaatacaagaggtaaccccaggacagtttctccacaatgaagttgtgccaatagagctccagaaaaatgtctctcttctctggcctttacttaaagaagggataacaagcgccttgacttctttccctttcctccttagggaagacattcttccaagtatcaagaaagggagcccttgcttccctggaagacatttcgtcccagcaatcactctccagttccatgtgatcattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgcccccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtatcaaaggagctctatttaggctatgttctccgatgtacatcccctggtttgaaacggtttaaggaatgtgttcaactcccgacaattgttttttcataattttgacctacttctcatggagagaggaggatgacattttttgaatattggcatctcatactttgatgcttacatttccatggcaaatagctacaggaggacaacacaggcctccaggctcttatgggatcttcctttcccttgacagggtttgcacaagtgacttagcctttcttagggaaaaagaaggattctatgatatccaaaaaggctgtcctccccagaatgggttcacaaagggcaattcctctagcagatattccaaagatctcaccccagagacaatttacccatgtggatagggtgagataatcatttttaccttggtgcccaccacattcatatttttttcatggtatcatttagggcacttactgaacctcactgcagaatcactgaggaaaaaaagctctacacattaggttgatacagggtaacaccaggtgtttaaagaacctaattccactttgattcataacaccaaggcctgactttagtccagtaagagtgcttacactcacgttttacagcagggcaacccataacacgttgacaaaaatggatacatgtatagacatgggttccgtggcctcggtccaggattctcgggagattttcaggaatcacctttcactttgagtcaggtcgtacaacatagaccttacagaggtctgatgccacatttgcactttgagcaaaaacacacagttactttaatcaccctcgaaatacctatctgtagttattttattcaattatttttttgtcctatccatagaactagggcagctaaacttgagtgttgatacctacaaaattgtgaggctaaggtcacatgtgatgtggctgttgcttcgagaggaagcagtaaatctttatttgaatgccagggatcctttgtgtgtccactgatgtttctgtatggtagccaggaagacttgtgtgtgctgtgatggtaataatacaagaggtaaccccaggacagtttctccacaatgaagttgtgccaatagagctccagaaaaatgtctctctcctctgacctttatttaaagaagggacaacaagcgccttgacttctttccctttcctccttagggaagacattcttcaaagtatcaagaaagggagcccttgcttccctggaagacatttcatcccagcaatccctctccagttccatgtgaccattcctattctgagccagttttggaaaggaaggtaagtggttggattaggttaggtgatatccaagtagaggtagccgaattctgtctaggactgggtcaatgatgacaacccaatgtcatgaagaaatgtgatgacataaaattcattctcaataggattacactgaggcccaaccagggcgacagggttacaagaggtccattgactccttggggggctcttgggtgacttccctgcagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtattttgcagtcatctcacatgccaccttggaaggcagagcaacacagataatcaggtaagtggtcagaacatggtaaagcctccacatccaggtgacctcccccttcattatttggctttcaattctcagccagtctgtccttttggaattagggataacaaaatggtatgcaacggtaccaaaggagctctatttaggctatgttctccgatgtacatcccctggtttgttagggtttaaggaatatgttcaactcctgacaatagttttttcataattttgacctacttctcatggagagaggaggatgacattttttgaatattggcatctcatactttgatgcttacaattccattggaaatagctacaggaggacaacacaggcctccagggccttatgggactcttcctttcccttgacaggggaggcccaagtgacagagcttttcttagggaaaaaaaaggattctatgatatccaaaaaggctgtactccccaggatgggttcacaaagggcaattcctctagcagatattccaaagatctcaccccagagaaaatttacccatgtggatagggtgagatattcatttttaccttggtgcccaccacattctaaatttccttcatggtatcatttaggggaattactgaacctcactgcagaatcactgaggagaaaaagctctacacattaggttgatagagggtaaggccaggtatttaaagaacctaattccactttgattcataacaccaagccctgacttgagtccagcaacagtgggtaccgtcacgttttaaacagggcaacccataacacctcgacacaaatggatccatgtttagacatgggttctgtggcctgggcccaggattctcggtagattttcaggaatcaactttcatgttgagtcgggtcttacaacatagaccttacagaggtctgatgtcacatttgcactttgagcaaaaacatacagttactttaatcaccctggaaatacctatctgtagttgttttattcaattatttttttgtcctatccatagaacttgggcagctcaacttgagtgttgatacctacaaaattgtgaggctaaggtcacatgtgatgtggctgttgcttcgagaggaagcagtaaatctttattggaatgccagggatcctttgtgtgtccactgatgtttctgtatggtagccaggaagacttgtgtgtgctgggctggtagtaatacaagaggtaaccccaggacagtttcaccataatgaagttgtgccaatagagctccagaaaaatgtctctctcctctgacctttatttaaagaagggacaacaagcgccttgacttctttccctttccgccttagggaagacattcttccaagtatcaagaaagggagcccttgcttccctggaagacatttcgtcccagcaatcactctccagttccatgtgaccattcctactctgagccagttctggaaaggaaggtaagtggttggtaggttaggtgatatccaagtagaggtagccgaattcggtctaggactgggtcaatgatgacaacccaatgtcatgaagaaaagtgatgacagaaaatccatgctcaataggattacgctgaggcccaaccagggcgacagggtcacaagaggtccgttgactccttggggggctctgggtgacttccctgaagtcctcagatgcccttgccctgtttcccatgagaggaaatgtggacatctagggtgcacattggttggcaaacactgcatgccaataagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagtctccacatccaggtgacctcccccttcatgatttagctttcatttctcagccagtctgtccttttggaatttggggataacaaaatggtatgcaaaggtaccaaaggagctcgatttaggctatgttctctgatgtacatcccctggtttgtaacattttaaggaatgtgttcaacacccgataattgttttttcataattttgacctacttctcattgagagaggagcatgacattttttgaatcttaggatctcatactttgatgcttacaattttatgtcaaatagctacagtaggacaacacaggcctccagggccttatgggatcttcctttcccttgacaggggaggcccaagtgactgatcctttcttagggaaaaagaaggattctatgatatacaaaaaggctgtcctccccaggatgggttcacaaagggcaatccctctagcagatattccaaagatctcaccccagagacaatttaccaatgtggatatggtgagatattcatttttaccttagtgcccaccacattcaaatttccttcatggtatcatttagggcacttactgaacctcactgcagaatcactgaggaaaaaaagctctacacattaggttgatacaggttaaggccaggtgtttaaagaacctaattccactttgattcataacaccaaggcctgacttgagtccagcaacagtggttaccctcacgttttacagcaggacaacccataacaccttgacaaaaatggatccatgtatagacatgggttctgtggcctgggcccaggattctcgggagattttcaggaatcacctttcgcgttgagtcgggtctttcaacatagaacttacagaggtctgatgctacatttgcactttgagcaaaaacacagttactttaatcaccctcgaaatacctatctgtagttgttttattcaattatttatttgttctatccatagaacttgggcagctcaacttgagtgttgatacctacaaaattgtgaggctaagttcacatgtgatgtggctgttgctttgagagcaagcagtaaatctttattagaatgccattgttcctttgtgtgtccactgatgtttctctatggtagccaggaagacttgtgtgtgctgggctggtagtagtacaagaggtaaccccaggacagtttctgcacaatgaagttgtgccagtagagctccagaaaaatgtctctctcctctgacctttatttaaagaagggacaacaagcgccttgacttctttccctttcctccttagggaagacattcttcaaagtatcaagaaagggagcccttgcttccctggaagacatttcgtcccagcaatcaatctccagttccatgtgaccattcctactctgtgccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaccaggacgacaggtttacaagaggtccattgacttcttggggggctcttgggtgacttccctgaagtccgcagataaccttgcctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctgctgttttacagtcatctcacatgccaccttgaaaggcagagaaacacagataatcaggtaggtggtcagaacatggtaaagcctccacatccaggtgacatccccgtcatgatttggttttcaattctcagccagtctgtccttttagaattagggataacaaaatggtatgcaatggtaccaaaggagctctatttaggctatgttctccgatgtacatcccctggtttgtaatggtttaaggaatgtgttcaactcccgacaattgttttttcataattttgacctacttctcatggagagaggaggatgacattttttgaatattggcatctcatactttgatgcttacaattccattggaaaaagctacaggaggacaacacaggcctccagggacttatgggactcttcctttcccttgacaggggaggcccaagtgacagagcctttcttagggaaaaaaaggattctatgatatccaaaaaggctgtactccccaggatgggttcacaaagggcaattcctcgagcagatattacaaagatctcaccccagagaaaatttacccatgtggatagggtgagatattcatttttaccttggtgcccaccacattctaaatttccttcatggtatcatttagggcacttactgaacctcactgcagaatcactgaggaaaaaaagctctacacatagggtgatacagggtaaggccaggtgtttaaagaacctaattccactttgattcataacaccaaggcctgacttgagtccagcaacagtggttaccctcacgttttacagcagggcaacccataacaccttgacacaaatggatgcatgtatagacatgggttctgtggcctgggcccaggattctcgggagattttcagtaatcacctttcactttgagtcgggtcgtacaacatagacattacagaggtctgatgccacatttacactttgagtaaaaacacacagttactttaatcaccctcgaaatacctatctgtagttgttttattcaatttttttgtcctatccatagaacttgggcagctcaacttgagtgttgatacctacaaaattgtgaggctaaggtcacctgtgatgtggctgttgcttcgagaggaaacagtaaatctttattggaatccagggttcttttgtgtgtccactgatgtttctctatggtagccaggaagacttgtgtgtgctggactggtagtaatacaagaggtaaccccaggacagtttctgcacaatgaagttgtgccagtatagctccagaaaaatgtctctctcctctgacctttatttaaagaagggacaacaagcgccttgacttctttccctttcctccttagggaagacattcttccaagtatcaagaaagggagcccttgcttcactggaggacatttcctcccagcaatccctctccagttccatgtgaccattcctactctgagccagttctggaaaggaaggtaagtggttggattaggttaggtgatatccaagtagaggtagccgaattctgtctaggactgggtcaatgatgacatcccaatgtcatgaagaaaggtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaacctagggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacatccccttcatgatttggctttcaattctcagccagtcggtccttttggaatttgggataacaaaatggtatgcaacggtaccaaaggagctctatttaggctataatctccgatgtacatccccaggtttgtaacggtttaaggaatgtgttcaactcccgacaatagttttttcataattttgacctacttctcatggagagaggaggatgacattttttgaatattggcatctcatactttgatgcttacaattccattggaaaaagctacaggaggacaacacaggcctccagggccttatgggactcttcctttcccttgacaggggaggcccaagtgacagagcctttcttagggaaaaaaaggattctatgatatccaaaaaggctgtactccccaggatgggttcacaaagggcaattcctcgagcagatattacaaagatctcaccccagagaaaatttacccatgtggatagggtgagatattcatatttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgacttgagtccagcaacagtggttaccctcacgttttacagcagggcaacccataacaccttgacacaaatggatgcatgtatagacatgggttctgtggcctgggcccaggattctcgggagattttcagtaatcacctttcactttgagtcgggtcgtacaacatagacattacagaggtctgatgccacatttacactttgagtaaaaacacacagttactttaatcaccctcgaaatacctatctgtagttgttttattcaatttttttgtcctatccatagaacttgggcagctcaacttgagtgttgatacctacaaaattgtgaggctaaggtcacctgtgatgtagctgttgcttcgagaggaaacagtaaatctttattggaatccagggttcctttgtgtatccactgatgtttctctatggtagccaggaagaattgtgtgtgctgggctggtagtaatacaagaggtaaccccaggacagtttctgcacaatgaagttgtgccagtatagctccagaaaaatgtctctctcctctgacctttatttaaaaaagggacaacaagcgccttgacttctttccctttcctccttagggaagacattcttccaagtatcaagaaagggagcccttgcttccctggaggacatttcctcccagcaatccctctccagttccatgtgaccattcctactctgagccagttctggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacatccccttcatgatttggctttcaattctcagccagtctgtccttttggaatttgggataacaaaatggtatgcaacggtaccaaaggagatctatttaggctatgttctccgatgtacatccccaggtttgtaacggtttaaggaatgtgttcaactcccgacaattgttttttcataattttgacctacttctcatggagagaggaggatgacattttttgaatattggcatctcatactttgatgcttacaattccattggaaaaagctacaggaggacaacacaggcctccagggccttatgggactcttactttcccttgagaggggaggcccaagtgacagagcctttcttagggaaaaaaaaggattctatgatatccaaaaaggctgtactccccaggatgggttcacaaagggcaattcctctagcagatattccaaagatctcaccccagagaaaatttacccatgtggatagggtgagatattcatttttaacttggtgcccaccacattccaaatttccttcatggtatcatttagggcacttactgaacctcactgcagaatcaatgaggaaaaaaagctctacacattaggttgatacagggtaaggccaggtgtttaaagaacctaattccacattgattcataacaccaaggcctgacttgagtccagcaacagtggttaccctcacgttttacagcagggcaacccataacaccttgacacaaatggatgcatatatagacatgggttctgtggcctgggcccaggattctcgggagattttcagtaatcacctttcacgttgagtcgggtcgtacaacatagacattacagaggtctgatgccacatttacactttgagtaaaaacacacagttactttaatcaccctcgaaatacctatctgtagttgttttattcaatttttttgtcctatccatagaacttgggcagctcaacttgagtgttgatacctacaaaattgtgaggctaaggtcacctgtgatgtggctgttgcttcgagaggaaacagtaaatctttattggaatccagggttcctttgtgtatccactgatgtttctctatggtagccaggaagacttgtgtgtgctgggctggtagtaatacaagaggtaaccccaggacagtttctgcacaatgaagttgtgccagtatagctccagaaaaatgtctctctcctctgacctttatttaaagaagggacaacaagcgccttgacttctttccctttcctccttagggaagacattcttccaagtatcaagaaagggagcccttgcttccctggaggacatttcctcccagcaatccctctccagttccatgtgaccattcctactctgagccagttctggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaaaagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccactatggaaccttgggcatttctgcaaggatcgcaccttgctcatgacaatgtcttttctggtgttttgcagtcatctcacatgccaccttggaaggcagagaaagacagataatcaggtaagtggtcagaacatggtaaagcctccacatccaggtgacatccccttcatgatttggctttcaattctcagccagtctgtcctttttgaatatggggataacaaaatggtatgcaacagtaccaaaggagcttgatttaggctatgttctcccatgcagatcccctagtttgtaaagttttaaggaatgtgttctaatcccgaaaattgttttttcataattttgacctacttctcatggatagaggaggatgacatttttgaactcattcggttgatacagggtaaggccatgtgtttaaagaacctaattccactttcattcataacaccaaggcctgatttgagtccagcaacagtggttaccctcacgttttacagcagggcaacccataacaccttgacacaaatggatacatgtatagagatgggtttgtggcctgggcccaggattctcgggagattttcaggaatcacctttcacattgagtcgggtcttacaacatagaccttacagaggtctgatgccacatttgcactttgagcaaaaacacacagttactttaatcaccctcgaaatacctatctgtagtttttttattcaattatttttttgtcctatccatagaacttgggcagctcaacttgagtgttgatacctacaaaattgtgaggctaaggtaacatgtgatgtggctgttgcttcgagaggaagcagtacatctttattggaatgccagggttcctttctgtgtccactgatgtttctctgtggtagccaggaagacttgtgtgtgctgggctggtagtattacaagaggtaaccccaggacagtttctgcacaatgaagttgtcccagtagagctccagaaaaatgtctctctcctcagatctttatttaaagaagggacaacaagcgccttgacttctttccctttcctccttagggaagacattcttccaagtatcaagaaagggagcccttgcttccctggaagatatattctcccagcaatcctcctccagttccatgtgaccattcctactctgagccagttttggaaaagaaggtaagtagttggattaggttacgtgatatccaagtagaggtagccgaattctgtctaggactgggtcaatgatgacaacccaatgtcatgaagaagggtgatgacataaaattcatgctcaataggattacgctgaggcccaaccagggcgacagggtcacaagaggtcagttgactcctttgggggccttatggtacacttcctttcccttgagaggggaggcccaagtgacagatcctttcttaggtaaaaagaaggattctatgatatccaaaaaggctgtcctccccaggatgggttcacaaagggcaatccctctagcagatattccaaagatctcaccctagagacaatttacccatgtggaaagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgacttgagtccagcaacagtggttaccttcatgttttacagcagggcaacccataacaccttgacacaaatggatccatgtatagacatgggttctgtggtctgggcccaggattctccggagaatttcaggaatcacctttcactttgagtcgggtcgtacaacatagaccttacagaggtctgatgccacatttgcactttgagcaaaaacacagttactttaatcaccctccgaatacctatctgttgttgttttattcaattatttttttctcctatccatagaacttgggcagctcaacatgagttttgatacctacaaaattgtgaggctaaggttacatgtgatgtggctgttgcttcgagaggaagcagtaaatctttattggaatgccagggttcctttctgtgtccactgatgtttctctatggtagccaggaagacttgtgtatgctgggctggtagtaatacaagaggtaactccaggacagtttctgcataatgaagttgtgccagtagagctccagaaaaatgtctctctcctctgacctttatttaaagaagggacaacaagggccttgacttctttccctttcctccttagggaagacattcttccaagtatcatgaaagggagcccttgcttctctggaagacatttcctcccagcaatccctctccagttccatgtgaccattcctactctgagccagttttggaaaggaaggtaagtggttggattaggttaggtgatatccaagtagaggtagccaaattctgtctaggactgggtcaatgatgacaacccaatgtcatgaagaaaggtgatgacataaaattcatgctcaataggattacgctgaggcccaaccagggtgacagggtcacaagaggtccgttgactccatggggggctcttgggtgacttcaatgaagtcctcagatgccctttccctgtttcccatgagaggaaatgtggacatctagggtgcacattggttggcaaacactgcatgccaacaagcacctagtcccacaatggaaccttgggcagttctgccagtattgtcccttgcgcatgacagtgtcttttctggtgttttgcagtcatctcacatgccaacttggaaggcagagaaacacagataatcaggtatgtggtcaggacatggtaaagcctccacatccaggtgacctcccccttcatgtattggctttcaattctcagccagtttgtccttttggaatatggagataacaaaatggtatgcaacggtaccaaaggagctcgatttaggctatgttctcccatgcagatcccctggtttgtaaagttttaaggaatgtgttctactcccgataattgttttttcataattttgacctacttctcaaggagagaggaggatgacattttttgaatgttgggatctcatatttgatgcttaaaattccatgacaaatagctacaggaggacaaaataggcctccagggccttatgggctcttcttttcccttgacaggggaggctcaagtgacagagattttcttagggaaaaagaaggattctatgatatccaaaaagactgtcctccccaagatgggttcacaaagggcaatccctctagaagatattccaaagatctcaccccagagacaatttacccatgtggaaagggtgagataatcatttttgcctaagtgcccaccacattcatatttccttcatggtatcatttagggcacttactgaacctcactgcagaatcaatgaggaaaaaaacctctacacaataggctgatacagggtaaggccaggtgtttaaagaacctaattccactttgattcataacaccaaggcctgacttgagtccagcaacagtggttaccctcacgttttacagcagggcaacccataacaccttgacacaaatggatgcatgtatagacatgggttctgtggactgagaccaggattctctggagattttcaggaagcacctttcacgttttgtctggtcatacaacatagaccttacagatgtctgattccacatttgcactttgagcaaaaacacacagttactttaatcaccctcgaaatacctatctgtagttgatttattcaattatttttttgtcctatccatagaacttgggcaactcaacttgagtgttgatacctacaaaattgtgaggctaaggtcacatgtgatgtggctgttgcctcaagaggaagcagtaaatctttattggaatccagggttcctttgtgtgtccactgatgtttctctatggtagccaggaagacttgtgtgtgctgggctggtagtaatacaagaggtaaccccaggacagtttctgcacaatgaagttgtgccagtagagctccagaaaaatgtctctctcctctgacctttatttaaagaagggacaacaagggccttgacttctttccctttcctccttagggaagacattcttccaagtatcatgaaagggagcccttgcttccctggaagacatttcgtccgagcaatccctctccaggtccatgtgaccattcctactctgagccagttttggaaagaaaggtaagtagttggattaggttaggtgatatccaagtagaggtagccgaattctatctaggactgggtcactgatgacaacacaatgtcatgaagaaaggtgatgacataaaattcatgctcaataggattactttgaagcccaaccagggtcacagggtcagaagaggtccattgactctttggggggctcttgggtgacttcaatgaagtcctcagatgcccttgccctgtttcccatgagaggaaatgtggacatctagggtgcacattggttggcaaacactgcatgccaacaagcacctagtcccacaatggaaccttgggcatttctgcaaggattgtcctttgcgcatgacagtgtcttttcttgtgttttggagtcatctcacatgccaccttggaaggcagagacacagataatcaggtaagtggtcagaacatggtaaagcctccacatccaggtgacctcacccttcatgtattggctttcaattctcagccagtctgtccttttggaatatggggataacaaaatggtatgcaactgtatccaaaggagctcgatttaggctatgttctcccatgcagatcccctggattgtaacgttttaaggaatgtgttcaacgcccgataattgttttttcataattttaacctacttctcatggagagtggagaatgacattttttgaatgttgggatctcatactttgatgcttacaattccatggcaaatagctacaggaggacaacacaggccttcagggccttatgggactcttcctttcctttgacagggaggcccaaatgacagagccgtcttagggaaaaagaaggattctatgatatccaaaaaggctgtcctccccaggatgggttcacaaagggcaatcactctagtagatattccaacgatctcaccccagagacaatttacccatgtggatagggtgagatattcatttttaccttggtgcagaccacattccaaatttccttcattttatcatttagggcacttactgaacctcactgcacaatcactgaggaaaaaaagctctacacaataggttgatacagggtaaggccaggtgtttagagaacctaattccactttgattcataacaccaaggtctgacttgagtacagcaacagtggttaccctcacgttttacagcagggcaacccataacacctttacacaaatggttccatgtatagacattggttctgtggcctgggcccaggattttcgggagattttcaggaatcacctttcacattgagtcgagtcgtacaacatagaccttacagaggtctgatgccacatttgcactttgagcaaaaacacacagttactttaatcaccctcgaaatacctatctgtacttgtttcattcaattatttttttgtcctatccatagaattttggcagctcaacttgagtgttgatacctacaaaattttgagtctaaggtcacatgtcatgtggctgttgctttgagaggaaccaggaaatctttattggaatgccagggttcctttttgtgtccactgatgtttgtctatggtagccaggaagacttgtgtgtgctgggctggtagtaatacaagaggtaaaccccggacagtttctgcacaatgaagttgtgcctgtagagctccagaaaaatgtctctctcctctgacctttatttaacgaagggacaacaagcgccttgacttctttccctttcctctttagggaagacattcttccaagtatcaagaaagtgagcccttgcttccctagaagacatttcgttccagcaatccctctccagttccatgtgaccattcctactctgagccagtattggaaagaaaggtaattggttggattaggttaggtgatatccaagtagaggtagccgaattctgtctaggactggttcaatgatgacaacccaatgtcatgaagaaaggtgatgacataaaattcatgcacaataggattacgctgaggcccaaccagagcgacagggtcacaagaggtccattgactccttggggggctcttgggtgacttcccagaagacctcagatgtccttgccctgtttcccatgagaggaaatgtggatatctagggtgcacattggttggcaaacactccatgccaataagcacctagtcccacaatggaaccttgggcatttctgcaaggatcgtcccttgctcatgacaatgtcttttctggtgttttgcagtcatctcacaaccttggaaggcagagaatcacagataatcaggtaagtagtcagaacatggtaaagcctccacatccaggtgacctcccctttcatgctttggctttcaattcttggccaggctgtccttttggaatttggggataacaaaatggtatgcaacggtactaaaggagctcgatttaggctatgttctcccatgcagatcccctgatttgtaaagttttagaaatatgttcaactcccgataattgttttttcataattttgacctacttctcatggagagaggaggatgacattttttgaatgttgggatctcatactttgatgcttacaattccattggaaaaagctacaggaggacaacacaggcctccagggccttatgggactcttcctttcccttgacaggggaggcccaaatgacagagcctttcttagggaaaaagaaggattctatgatatccaaaaaggctgtcctccccatggtgggttcacaatgggcaatccctctagcagatattccaacgatctctccccagagacaatttacccatgtggatagggtgagatattcatttttaccttggtacccaccacattccaaatttccttcatggtatcatttagggcacttactgaacctcaccacagaatcactgaggaaaaaaagctctacacattaggttgacacagggtaaggccaggtgtttagagaacctaattccactttgattcataactccaaggtctgacttgagtccagcaacagtggttaccctcatgttttacagcagggcaacccataaaacctttacacaaatggttccacgtatagacatgggttttgtggactgggcccaggattttcgggagattttcaggaatcacctttcacgttgagtcgggtcatacaacatagacctttcagaggtctgatgccacatttgcactttgagcaaaaacacacagatactttaatcaccctccaaatacctatctgtagttgttttattcaattatttttttgtcctatccatagaactttggcagctcaacttgagtgttgatacctacaaaattgtgaggctaaggtcacatgtgatgtggcttttgctttgagaggaagcattaaatctttactggaatgccagggttccttcctatgtccgctgatgtttctctatggtagccaggaagacttgtgtgtgctgggctggtagtaatacaagaggtaaccccaggacagtttctgcacaatgaagttgtgcctgtagagctccagaaaaatgtctctctcctctgacctttatttaagaatggacaacaagtgccttgacttctttctctttcctccttagggaagacattcttccaagtatcaagaaagggagcccttccttccctagaagacatttcgttccagcaatccctctccagttccatgtgaccattcctactctgagccagttttggaaaggtaggtaattggttggattaggttaggtgatatccaagtaagatagccgaattctgtctaggactgggtcaatgatgacaacccaatgtcatgaagaagagtgatgacataaaattcatggtcaataggattacactgagacacaaccagggcgacagggtcacaggaggtccattgactccttaaggggctcttgggtgacttccctgaagtcctcagatgcccttgccctgtttcccataagaggaaatgtggacatctagggtgcacattggttggcaaacactccatgccaacaagcaccttttcccacattggaaccttgggcgtttctgcaaggatcgtcccttgctcatgaaaatgtcttttctcttgttttgcacttatgtcacaagccaccttggaaggcagagaaacacagataatcaggtaagtggtcagaatatggtaaagcctccacatccaggtgaccgcccccttcatgctttggctttcaattcacagccagtctgtccttttggaatttggggataacaaaatggtatgcaacagtaccaaaggagctcgatttatgctatgttctcccatgcagatcccctggtttgtaaagttttaggaatatattcaactcccgataattgttttttcataatttttacctacttctcatggagagaggaggatgacattttttgaatgttgggatctcatactttgatgcttacaattccatggcaaatagctacaggaggccaacacaggcctcaaggccttatgggactcttcctttcccttgacaggggaggcccaaatgacagagcctttcttagggaaaaagaaggattctatgatatccaaaaaggctgtcctccccatggtgggttcacaaagggcaatccctctagcagatattccaacgatctctccccagagacaatttacccatgtggatagggtgagatattcatttttacctggtgcccaccacattccaaatttccttcatggtatcatttagggcacttactgaacctcaccacagaatcactgaggaaaaaaagctctacacattaggttgacacagggtaaggccaggtgtttagagaacctaattccactttgattcataactccaaggtctgacttgagtccagcaacagtggttaccctcacgttttacagcagggcaacccataacacctttacacaaatggttccatgtatagacatgggttttgtttactgggcccaggattttcgggagattttcaggaatcacctttcacgttgagtcgggtcatacaaatagacctttcagaggtctgatgccacatttgcactttgagcaaaaacacacagttactttaatcaccctcgaaatacctatctgtagtttttttattcaattatttttttgtcctatccatagaactttggcagctcaacttgagtgttgatacctacaaaattgtgaggctaaggtcacatgtgatgtggctgttgctttgagaggaagcattaaatctttactggaatgccagggttccttcctatgtccgctgatgtttctctatggtagccaggaagacttgtgtgtgctgggctggtagtaatacaagaggtaaccccaggacagtttctgcacaatgaagttgtgccagtatagctccagaaaaatgtctctctcctctgaccttcatttaagaatggacaacaagtgccttgacttctttctctttcctccttagggaagacattcttccaagtatcaagaaagggagcccttccttccctagaagacatttcgttccagcaatccctctccagttccatgtgaccattcctactctgagccagttttggaaagtaggtaattggttggattaggttaggtgatatccaagtagaggtagcagaattttgtctaggactgggtcaataatgacaacccaatgtcatgaagaagagtgatgacataaaattcatgctcaataggattacgctgagacccaaccagggcgagagggtcacaggaggtccattgactccttggggggctcttgggtgaattccctgaagtcctcagatgcccttgccctgtttcccataagaggaaatgtggacatctagggtgcacattggttggaaaacactccatgccaacaagcacctagtcccacattggaaccttgggcatttctgcaaggatcgtcccttgctcatgaaaatgtcttttctgttgttttgcagttatgtcacaagccaccttggaaggcagagaaacacagataatcaggtaagtggtcagaatatggtaaagcctccacatccaggtgacctcccccttcatgctttggctttcaattcacagccagtctgtccttttgtaatttggggataacaaaatggtatgcaacagtaccaaaggagctcgatttaggctatgttctcccatgcagatcccctggtttgtaaagttttaggaatatgttcaactcccgataattgtattttcataattttgacctacttctcatggagagaggatgacattttttgaatgttgggatctcatactttgatgcttacaattccatggcaaatagctacaggaggacaacacaggcccccagggctttatgggactcttcctttcccgtgacaggggaggcccaagtgacagagcctttcttagggaaaaagaaggattctatgatatccaaaaaggctgtcctccccatggtgggttcacaaagggcaatccctctagcagatattccaccgatctctccccagagacaatttacccatgtggatagggtgagatatacatttttacctggtgcccaccacattccaaatttccttcatggtatcatttagggcacttactgaacctcaccacagaatcactgaggaaaaaaagctctacacattaggttgacacagggtaaggccaggtgtttagagaacctaattccactttgattcataactccaaggtctgacttgagtccagcaacagtggttaccctcacgttttacagcagggcaacccataacaccttgacacaaatggatccatgtatagacatgggttctatggcctgggcccaggattatcgggagattttcaggaatcacctttcacgttgagtcgggtcatacaacatagaccttacagaggtctgatgccacatttgcactttgagcaaaaacacacatttactttaatcaacctcgaaatacctaactgtagttgttttattcaattattttttgtcttatccatagaacttgggcagctcaacttgagtgttgatacctacaaaattgtgaggctaaggtcacatgtcatgttgctgttgcttcgagaggaagcagtaaatctttattggaatgccagggttcctttgtgtggccactgatgtttctctatggtagccaggaagacttgtgtgtgctgggctggtagtaatacaagaggtaacaccaggacagtttcttttttttttttttatttttttttcctttccattttattaggtatttagctcatttacatttccaatgctataccaaaagtcccccataaccacccacccccactcccctacctgcccactccccctttttagccctggcgttcccctgttctgtggaatataaagtttgtgtgtccaatgggcctctctttccagtaatggccgactaggccatcttttgatacatatgcagctagagtcaagagctccggggtactggttagttcataatgttgaaccacctatagggttgcagatccctttagctccttgggtactttctctagctcctccattgggagccctgtgatccatccattagctgactgtgggcatccacttctgtgtttgctaggcccctgcatagtctcacaagagacagctacatctgggtcctttcgataaaatctagctagtgtatgcaatggtgtcatcgtttggatgctgattatcgggtggatccctggataaggcagtctctacatggtccatcctttcatctcagctccaaactttgtctctgtaactccttccaagggtgttttgttcccacttctatggaggggcatagtgtccacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtactactccattgtgtagatgtatcacattttctgtatccattcctctgttgaggggcatctgggttctttccagattctggctattataaataaggctgctatgaacatagtggagcatgtgtccttcttaccagttggggcatcttctggatatatgcccaggagaggtatggctggatcctccggtagtactatgtccaattttctgaggaaccgccagacggatttccagagtggttgtacaagcctgcaatcccaccaacaatggaggagtgttcctctttctccacatcctcgccagcatctgctgtcacctgaatttttgatcttagacattctgactggtgtgaggtggaatctcagggttgttttgatttgcatttccctgatgattaaggatgttgaacattttttcaggtgtttctctgccattcggtattcctcaggtgagaattctttgttcagttctgagccccattttttaatggggttatttgattttctgaagttcaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaattttttcccctgtgcccgtattttcaaggcttttccccactttctcctctataagtttcagtgtctctggttttatgtgaagttctttgatccatttagatttgaccttagtacaaggagataagtgtggatcgattcacattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttaccacaattgctctgtagtaaagctttaggtcaggcatggtgattccaccagaggttcttttatccttgagaagagtttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagacttgaagtttttatcatacagatctttcacttccttagttagagtcacaccgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcctcctttccaatttgtatccccttgatctccttttgttgtcgaattgctctggctaatacttcaagtactatgttgaaaaggtagggagaaagtgggcagccttttctagtccctgattttagtgggtttgcttccagcttctctccattaactttgatgttggctactggtttgctgtagattgcttttatcatgtttaggtatgggccttgaattcctgatctttccagaacttttataatgaatgggtgttggatcttgtcaaatgctttttctgcatctaacgagatgatcatgtggtttttgtttttgagtttgtttatatagtggattacattgatggattttcgtatattaaaccatccctgcatccctggaataaaacctacttggtcaggatggatgattgctttaatgtgttcttggattcggttagcgagaattttattgaggatttttgcatcaatattcataagagaagttggtctgaagttctctatctttgttggatctttctgtggtttaggtatcagagtaatagtggcttcataaaatgagttgggtagagtaccttctacttctatcttgtgaaaaagtttgtgcagaactggaattagatcttctttgaaggtctgatagaactctgcactaaacccgactggtcctgggctttttttggctgggagactatttataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcagttctgattttgttaattaggattttgtctctgtgccctctagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagctttttttttttttccattttttattaggtatttagctcatttacatttccaatgctatactaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgagagccctgtaatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccgattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccattggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttggttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccaacacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaatttttttaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtgtagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcagagctatgagtttccctcttagaaatgctttcattgtgtcccataggtttgtgtatgttgtggcttcattttcattaaactctaaaaagtctttaatttctttctttattccttccttgaccaaggtatcattgagaagagtgttgttcagtttccatgtgagtgttggctttctgttattttttttttttgttattgaagatcagccttagtgcatggtgatctgataggatacatgggacaatttcaatatttttgaatctgttgaggcctgttttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggttcaatgtgtgctttgagctttactaaagtgtctttaatgaatgtggctgcccttgtatttggagcatagatattcagaattgagagttcctcttggagggttttacctttgatgagaacgaagtgcccctccttgtcttttttgataactttgggttggaagtcaatcttatcagatattaggatggctactccagcttgtttcttcataccatttgcttggaaaattgttttccagccttttattctgaggtagtgtctatctttttctctgagatgtgtctcctgtaaacagcaaaatgttgggtcttgtttgtgtagccagtttgttagtctatgtctttttattggggagttgagaccattgatgttaagagatattaaggaaaagtaattgttgcttcctgttatttttgttgttaaagttggcattctgttcttgtggctgtcttcttttaggtttgttgagggattaccttcttgttttttctagggcattgttcccgttcttgtattggtttttttctgttattaacctttgaagggctggattcgtggagagataatgtgtgaatttggttttgtcgtggaatactttggtttctccatctatggtaattgagagtttggctgggtatagtagcctgggctggaatttgtgttctcttagtgtctgtataacatctgtccaggctcttctggctttcatagtctctggtgaaaaatctggtgtaattctgataggcttgcttttgtatgttacttgacctttttcccttactgcttttagtattctatctttatttagtgcatttgttgttctgattattatgtgtcgggaggaatttcttttctggtccagtctatttggagttctgtaggcttcttgtatgttcataggtatctctttctttatatttgggaagttttcttcaataattttgttgaagatgtttgctggtcctttgagttgaaaatcttcattctcatccactcctattatccgtaggtttggtcttctcattgtgtcctggatttcctggatattttgagttaggatctttttgcattttctattttctttgattgtcgtgccgatgttctctatggaatcttctgcacctgagattctctcttccatcccttgtattctgttgctgatgctcaaatctatgcttccagatttctttcctagggtttctatctccagtgttgcctcactttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgggtgtgttggggtgccctggactgggcgaagtgggagtgctgggttctgatgatggtgagtggtcttggttcctgttagtaggattcctacatttacctttcgccatctggtaatctctggagttagtagttatagttgactctgtttagagattgttcttctggtgattctgttaccggctctcagcagacctgggagacagattctctcctctgagtttcagtgctcagagcactctctgctggcaagctctcttacagggaaggtgcgcagatatcttgtttttggacctcctcctggtcgaagaagaaggcccaaaacagggcctctctcagaagctgtgttgctttggcagttcctagaagctgtcagcttctgtggtgcagactctcacctgtgcagactaaattcctaagttccagggagtcctggaaccaagatggcgacctctgctcctgaggctgaggccgcctcccgagccaggcagacacctgtcctctggtccggacagtggacggctgtctgcagcccgccaagggtgctgcctcagtggctttgtgcttctgcccgtcccagaagctgtccggttctctggcgcaccctctaacctgttcagactaatttcctaggtaccgcggagacctggaacccagatggcgaccactgctgctgaggctgaggccgcctccaaagccaggcagacacctgtcctctggtccggacggtggccggctgtctgcggcccaccaagcactaggacagtttctgcacaatgaagttgtgccagtagagctccagaaaaatgtctctctcctctgacctttatgtacagaagggacaacaagcgccttgacttctttccctttcctccttagggaagacaatcttccaagtatcaagaaagggagcccttgcttccctggaggacatttcgtcccagcaatccctctccagttccatgtgaccattcctactctaagccagttttggaaaggaaggtaagtggttggattaggttaggcgatatccaagtaggggtaggctaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctcttgggtgacttccctgaagtcctcagatgcccttgccctgtttcccataagaggaaatgtggacatctagggtgcacattggttggcaaacactgcatgccaacaagcacatagtcccacaatggatccttgggaatttctgcaaagatcatcccttgctcatgacaatgtcttttctggtgttttacagtcatctcacatgccaccttggaaggcagagaaacacagataatcaggtaagtggtcagaacatggtaaagcctccacatccaggtgacatcccccttgatgctttggcttgaaattctcagccagtctgtccttttggaatttggggataacaaaatggtatgcaacggtaccaaaggagctcgatttaggctatgttctcccatgcagatcccatggtttgtaaagttttaaggaatgtgttcaactcccgataattgttttttcataattttgacctacttctcatggatagaggaggatgacattttttgaatgttgggatctcatactttgatgcttacaattccatggcaaatagctacaggaggacaacacaggcctccatggccttatgggactcttcctttccattgacaggggaggcccaagtgaaagagcctttcttagggaaaaagaaggattctatgatatccaaaaaggctgtcttccccaggatgtgttcaaaaagggcaatccctctagcagatattccaaagatctcaccccagagacaatttacccatgtggatagggtgagatattaattttttccgtggtgcccaccacatgccaaatttccttcatggtatcatttagagcacttactgaacctcaatgcagaatcactgaggaaaaaaagctctacacattaggttgatacagggtaaggccaggtgtttaaagaacctaattccaccttgattcaaaacaccaaggcctgacttgagtccagcaacagtggataccctcacgttttacagcagggcaacccataacaccttgacacaaatggatccatgtatagacatgggttttatggcctgtgtccaggattctggggagattttcaggaatcacctttcacattgagtcgggtcatacaacatagacctttcagaggtctgatgccacatttgcactttgagcaaaaacacacagttactttaatcaccctcgaaatacctatctgtagttgttttattcaattatttttttgtactatccatagaacttgggcagctcaacttgagtgttgataccaaaaaattgtgaggctaaggtcacatgtgatgtggctgttgtttcgagaggaaaaagtaaatctttattgaaatgccagggttcctttgtgtggccactgatgtttctctatggtagccaagaagacttgtgtgtgctgggctggtagtaatacaagatttaaccccaggacagtttctgcacaatgaagttgtgccagtagagctccagaaaaatgtctctctcctctgacctttatttaaagaagggacaacaagcgccttgacttctttccctttcctccttagggaagacattcttccaaatatcaagaaagggagcccttgcttccctggaagacatttcctccagcaatccctctccagttccatgtgaccattcctactctgagccagttttggaaaggaaggtaagtggttggattaggttaggtgatgtccaagtagaggtagccgaattctgtctaggactgggtcaatgatgacaacccaatgtcatgaagaaaggtgatgacataaaattcatgctcaataggattacactgaggcccaaccagggtgacagggtcacaacaggtccgttgactccttgaggggctcttgggtgacttccctgaagtcctcagatgaccttaccctgtttcccatgagaggaaatgtggacatctagggtgcacattggttggcaaacactgcatgccaacaatcaccgagtcccacaatggaaccttgggcatttcagcaaggatcttcccttgctcatgacaatgtcgtttctggtgttttgcagtcatctcacatgccaccttggaaggcagagaaacacagataatcaggtaagtggtcagaacatggtaaagccaccacatccaggtgacctcccccttcatgctttggctttcatttcacagccagtctgtccttttggaatttggggataacaaaaagttatgcaacggtaccaaaggagcacgatttaggctatgttctcccatgcagattccctggtttgtaaagttttaaagaatgtgttcaactcccgataattgttttttcataattttgacctacttctcatggagagaggaggatgatattttttgaatgttgtgatctcatactttgatggttacaattccatggcaaatagctacaggaagtcaacacaggcctccagggacttattggacacttcctttcccttgacagtaaggcccaagtgacagaacatttcttagggaaaaagaaggattctatgatatccaaaaaggctgtcctccccaggatgggttcacaaagggcaatccctctagcagatattccaaagatctcaccccagagacaatttccccatggggatagggtgagatatttatttttacctggtgcccaccacattccaaatttccttcatggtatcatttaggggacttactgaacctcactgcagaatcactgaggaaaaaaagctctacacattaggttgttacatggtaaggccaggtgtttaaagaacctaattccactttgattcataacaccaaggcctaacttgagtccagcaacagtggttaccctcacgttttacagcagggcaacccataacaccttgacacaaatggatccatgtttagacaggggttctgttgcctgggtccaggattctcgggagattttcaggaatcacctttcacattgagtcgggtcataaaacatagaccttacagaggtctgatgccacatttgcactttgagcaaaaacacacagttactttaatcaccctcctactacctatctgtagttgttttattcaattatttttttgtcctatccatagaacttgggcagctcaacttgagtgttgataccaaaaaattgtgaggctaaggtcacatgtgatgtggctgttgcttccagaggaagaagtaaatctttattggaatgccagggttcctttgtgtgtccactgatgtttctctatggtagccaggaagacttgtgtgtcctgggctggtagtaatacaagaggtaaccccaggacagtttctgcacaatgaagttgtgccagtagagctccagaaaaaactctctctcctctgacctttatttaaagaagggacaacaagcgccttgacttctttccctttcctccttagggaagacattcttccaagtatcaagaaagggagcccttgcttccctggaggacctttcctcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaagagtggtgatgacataaaattcatgctctacaggattacgctgaggcccaaccagggcgacagggtcacaacaggtccgttgactccttgggcggctcttgggtgacttccctgaagtcctcagatgcccttgccctgtttcccatgagaggaaatgtggacatctagggtgcacattggttggcaaacactgcatgtcaacaaccacctagtcccacaatggaatcttgggcatttctgcaaggatcatcccttgctcgtgacaatgtcttttctggtgttttgcagtcatctcacatgccacattggaaggcagagaaacacagataatcaggtaagtggtcagaacatggtaaagcctccacatccaggagacctcccccttcatgttttggctttcaattctcagtcagtctgtccttttggaatttggggataacaaaatggtatgcaacagtaccaaaggagctttatttaggctatgttctcccatgcagatcccctggtttgtaaaattttaaggaatgtgttcaactcccgataatttttttttcatgattttgacctacttctcatggagagaggaggatgacattttttgaatgttgggatctcatactttgatgcttacaattccatggcaaatagctacaggaggtcaacacaggcctccagggccttatgggactcttcctttcccgtgacaggggaggcccaagtgacagagcctttcttagggaaaaagaaggattctattatatccaaaaaggctgtcgccccaggatgggttcacaaagggcaatccctccagcagatataccaaagatctcaccccagagacaatttacccatgtggatagggtgagatattcatttttaccttggtgcctaccacattccaaatttccttcatggtatcatttagggcacttactgaacctcacagcagaatcactgaggaaaaaaagctctacatattaggttgatacagggtaaggccaggtgtttaaagaacctaattgcactttgattcacaacaaggtctgacttgagtccagcaacagtggttaccctcacgtattacagcagggcaacccataacaccttgacacaaatgtatccatgtatagacatgggttttgtggcctgggcccaggattctcgggagattttcaggaatcacctttcatgttgagtcgggtcatacaacatagaccttacagaggtctgatgccacatttgcactttgagcaaaaacacacagttactttacacactcgaaatacctatctgtagttgttttattcaattatttttttgtcctatccatagaacttgggcagctcaacttgagtgttgatacctacaaaattgtgagtctaaggtcacatgtgatgtggctgttgctttgagaggaagcagtaaatctttattggaatgtcagggttcctttgtgtgtccactaatttttctctatggtagccaggaagacttgtgtgtgctgggctggtagtaatataagaggtaaccccaggacagtttctatacaatgaagttgtgccagtagagctccagaaaaatgtctctctcctctgacctttatttaaagaagggacaacaagcaccttgacttctttccctttactccttagggaagacattcttccaagtatcaagaaagggagcccttgcttccctggaagacatttcctcccagcaatccctctccagttccatgtgaccatgcctactctgagccagttttggaaaggaaggtaagtggttggattaggttaggtgatatccaagtagaggtagccgaattctgcctaggactgggtcaatgatgacaacacaatgtcatgaagaaaggtgatgacataaaattcatgctcaataggattactttgaagcccaaccagggcgacaggttcacaagaagtccgttgaatccttgggggactcttgggtgacttccctgaagtcctcagatgccccttgcagtgtttcccatgagcggaaaagtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttgggaggcagagaaacacagataatcaggtaagtggtgagaacatggtaaagcctccacatccaggtgacatcccccttcatgttttggctttcaattctcagtcagtctgtccttttggaatttggggataacaaaatggtatgcaacggtaccaaagaagctcgatttaggatatgttctcccatgtagatccccttgtttgtaaagtattaaggaatgtgttcaactccggataatttttttttcataattttgacctacttctcatggagagaggaggatgacattttttgaatgttgggatctcatactttgatgcttactattccatggcaaatagttacaggaggacaacacaggccccgagggctttatgggactcttcctttcccatgacaggggatgcccaattgacagagcctttcttagggaaaaagaaggattctatgatatacaaaaaggctgtcctccccaggatgggttcacaaagggctatccctctagcagatattccaaagatctcacctcagagacaatttaccaatgtggatagggtgagatattcatttttaccttggtgcccaccacattccaaatttccttcatggtatcatttatggcacttactgaacctcactgcagaatcactgaggaaaaaaagctctacacattaggatgatacagggtaaggccaggtgtttaaagaacctaattccactttgattcataacaccaaggcctgacttcagtccagcaacattggttaccctcacgttttacagcagggcaatccataacaccttgacacaaatggatccatgtatagacatgggttctgtggcctgggtccaggattctcgggagattttcaggaatcacctttcacgttgtgtcgggtcgtacaaagtagaccttacagaggtctgatgccacatttgcactttgagcaaaaacacacagttactttaatcaccctcgaaatacctatctgtagttgttttattcaattattttttgtcttatgcatagaacttgggcagctcaacttgagtgttgatacctacaaaattgtaaggctatggtcacatgtgatgttgctgttgcttcgagaggaagcagtaaatctttattggaatccagggttcctttgtgtgtccactgatgtttctctatggtagccaggaagacttgtttgtgctgggctggtaataatacaagaggtaaccccaggaaagtttctgcacagtgaagttgtgccagtagagctccagaaaaatgtgtctctcctctgacctttatttaaagaagggacaacaagcgccttgacttctttccctttcctccttagggaagacattcttgcaggtatcaagaaagggagcccttgcttccctggaagacatttcgtcctagcaatccctctccagtttcatatgaccattcctactctgagccagttttggaaaggagggtgagtggttggattaggttaggtgatatccaagtagaggtagccgaattctgtctaggactgggtcaatgatgacaacacaatgtcatgaagaaaggtgatgacataaaagtcatgctcaataggattacgctgaggcccaaccagggcgacagggtcacaagaggtacgttgactccttggggggctctagggtgacttccctgaagtcctcagatgcccttgccctgtttcccatgagaggaaatgtggacatgtagggtgcacattggttggcaaacactgcatgccaacaagcacctagtcccacaatggaaccttgtgcatttctgcaagaatcgtcccttgctcatgacaatgtcttttctagtgttttgcagtcatctcacatgccaccttggaaggcagagaaacacagataatcaggtaagtggtcagaacatggtaaagcctccacatccaggtgacctaccccttcatggtttggcttttaattctcagtcagtctgtccttttagaatttggggataacaaaatggtatgcaatggtaccaaaggagctcgatttaggctatgttctcccatgtagatcccctggtttgtaaagttttaaggaatgtgttcaactccctataattttttttcataattttgacctacttctcatggagagaggaggatgacatttttgaatgttgggatctcatactttgattcttaccattccatggcaaatagctagaggaggacaacacagtcccccagggctttatgggactcttcctttcccttgacaggggaggcccaagtaacagagcctttcttagggaaaaagaaggattctatgatatacaaaaaggctgtcttccccaggatgggttcacgaagggcaatccctctagcagatattccaaagatctcaccccagagacaatttacccatgtggatagggtgagataatcatttttaccttggtgcccaccacattccaaatttccttcatggtatcatttagggcacttactgaacctcacagcagaatcactgaggaaaaaaaggtctacacattaggttgatacagggtaaggccaggtgtttaaagaacctaattccactttgattcataacaccaaggcctgacttgagtccagcaacagtggttaccctcacgttttacagcagggcaacccataatgtagtctcccctcccccagcctgaaacctgcttcctcaggtgtggagcttcctgctcatttgttctgccatgcccactgctggaacctgcgcagccacacacgtgcacctttctactggaccagagattattcggagggaatcgggtcccctcccccttccttcataactagtgtcgcaacaataaaatttgagctttgatcagagtaactgtcttggctacatctctttctctcgccacctagcccctcttctcttccaggtttccaaagtgcctttccacgctagaacccaggttgtggtctgctggccggacacaacaattggcaaaccaacgcgggactgagaaacggcaaaggatttttggaagagacgctgctggttcggagctccataaaataaaggataaaggaaattcataccggagaaggtatgggctaagctgagacagcgttaaaccctagcgctggttcacttaggttcagtagtgaggagctgggtaataggcggtaggctgtagctctctgaagctacatgaggcgtgagaaaagaaagggtttattaaaaggaatatgcggattgccccagttaataaaaaatgcatcataagggaggaaaatgtcccaaaaagcagagagaaatttctctctgggccttatagcaggagtactctgttcccttttgtgtcttgtctaatgtccggtgcaccaatctgttcttgtgttcaattcatgtatgttcgtgtccagtctgtatgaatgaatgttctatgttttatgttggataataaagatggtataaaaaactttatctgcaaagccaagagctgccacgtgtttcagccaggaatcagacacgtggcgggagggcccctgctagaaaaactgttcgttttaggaaataagggcgagtgcacagcctcttagtttcggagtaaaaaagctaataaatggttcatgattaatgtgtttgacaatggtaaagtgttttttattctatgattgtagctacaaaaattattattctctgattggtctaaatgtaactgcttcatttggttcttttttattggtaatgtgctctgagtgtcttcacattcagctcattagttgttggttaagattaataattgttacattgctacagatgtttagtgttaaatttgataactcaagtttagagtccttccgacacgtggcataaagcaggccaagaggctgggtctctaaagatatttctagtttaggtaataattaatgtggttcgtatcctaaatagtaaaatttaagataagatttaaagcaatgtctctttattaaagcattaaagcttgctttaataggtattcataggtattaattgacatccaaacttcgtaatatgatagtaatgcttctaatattgattttaaagataataaattgttttaaacttgggttttgctttcccaaggttataggtattatcctaaccttgcacaaaaaacttaaaaattatggttaaaactgctattgttccattgactgcagcttgcagtttgatttcaaatttaagatctttaattcacctgtatactgtaattaagataattacaagagtaatcatattatgagagcgctcatacagctcacttcatacaaaactgtgacaaagttatctagttatgtttgtctttgtgaatagattagacaaacagtttggttatagttgctgcctggcaggaaactgcagtacgggcaattttttcacaacactaaagttgtgaagaacgttttaactgtaagtcatcttaagaaagagtatcacaatttagaggcatagacagttatattgtttctctagaatcggtccttattacaagagggccaagatgctcagattaaaaagtattttacctttgagtcaatacatggctccgggcagccccagagcagcttgtggcctttcttttgttttgcaaacagtgcctgagaaagtttttttccctatgttcaagagaatttctttttaacagtgttacagatctattcacatgtttaaaataatgctttaattcaaagagttttgcttctagtgaactgtaatcactagaaaattctgcctctaggtatggctaatgtaactttacattatgtaagaaaaatttttattgtttctgcttctaaacaagaagccaagagttttaatctttcagtgtatattgtttcctaagtgaaaagtatattaactaatgcttcttaaagtttaccttaaattcttgctctcacccaaaagattcagagacaatatccttttattacttagggttttagtttactacaaaagtttctacaaaaaataaagcttttataattgttattcattggtaattaaaaattggttgtgcccaaaacaattctttggccaaaaagaaaaacattattgtaaagtcatttttctcatcctcccagccgatcgttggcccacgtgggcccaactagcttctgtggggcagagtcttaagacacagtttcccctgttccagcacagatgatctagttgtgtgctgtagatggtgttttaaaatgctgaacaatcaaaccttaatttgtatattaatagtcaatgccatatctctgagctcgcaattgcttaaattgttcatccctcagatactattaattctcaaatttacaattgcttatgcatatttctagttaataaataaattatgcacatgtgactcttaataactttacaagccttctagttacaaccgctccctaagaaaattgattgaaaaaacaattggtcgcttaatacattggtaaaatggaaggaccccctgactaataaatggaagggtccagatccagttctaatttggggtaggggctcagtttgtgtttttttcatgagatgaagatggagcgcagtggctgccagagagattaatttgtcagatgaacacagattctgactcttctggtaagtatcattctaaagactaaaattccttttgtgcttaaaattcagctgagagcgaaagctcccaaagctgttctccagctactctctgagccagctccccgacaggagactagcctcagctttacaatttgcatttgaataaagtacctggacttccccaaaagaagttctgctttcctactttctcactgtcaagattttgtctttcaagcaggtaaatcaacattctcgagccagaccagcagatgtgcattcctgccccgcccccccttgagagcacaggtgacagctgttatctccattctcaggacattccagcacgtggccttcagtctgatttaaaatttaggttttcctagagggctagaaaagtagatatttctatattaataaagattggtttttattttgatagacaggcttagtcccttagctgacctctggcttttcacccttgctgttactgcaaggtgtccttaggctgtgaaaaaaacagggatgaagaggaacgacttccagctcctattttagccacaaatcgtggtgttactaatgacataattcttgcctaggtcttgctaaatctgaggttgataattctcctttaggagctgcacagcactcagagctgtgcatactggtttgtgatcatacaaattcagtatgggcatcgcttggtgcagagagcactgcaggggaaggtccagcttgaccatttctgagtttcctgtgagataaacccggtttaaaagaggttggtatcatattttggctaaaaaccaaaaatatttttcggctctgcctcacctccccaaaagataccgagagccacaggtgtgggtcttaacagcatccacgggaggaatcgggtcaatgtccacccaagccaaggttaaaagcccactcatctacggatgaagaaaatcatttgatcacctacctcagttaagcgttgccttatttaacttaattaataggggagagagagattggagaccatactgtcttcactgcctcccaccccaaaataaaacagccaattggccttgtactacagagccagtcgaacgccttctccctgtttcccacctatcatccaaaaatgcagaggaatatcaacttagtgttattcttattatagtgtatttcacatttattcagtcaaacttagccagagttccaacgccctacttaaattcaactagaaatttacctaacaagtactaattagcattataaagtcagagcctacagctccaggcttttcagttagttgtttactaaaataagaaaagacagtcttagccagatacagtttaccataagaaaagttaagaatcccacaaaagcaagttttttctttagccctagattccaggcagaactattgagcatagataatttttcctcctcaggccagctttttcttttttttaagttttgttaataaaagggaggagatgtagtctcccctcccccagcctgaaacctgcttgctcaggggtggagcttcctgctcattcgttctgccacgcccactgctggaacctgcacagccacacacgggcacctttatactggaccacagattattcggcgggaatcgggtcccctcccccttccttcataactagtgtcgcaacaataaaatttgagctttgatcagagtaactgtcttggctaaatcactttctctcgccacctagcccctcttcacttgcaggtttccaaaatgcctttccaggctagaacccaggttgtggtctgctggccagacacaacaccataacaccttgacacaaatggatccatgtatagacatgggttctgtggcctgggcccaggattcttgggagattttcaggaatcaccattcactttgagtcgggtcatacaacatagaccttacagaggtctgatgccacatttgcactttgagcaaaaacacacagtttctttaatcaccctccaaatacctatctgtagttgttttattcaattatttttttgtcctatccatagaacttgggcagctcaacttgagtgttgatacctacaaaattgtgaggctaaggtcacatgtgatgtggctgttgcttcgagaggaagcagtaaatctttattggaatgccaaggttcctttgtgtgtccactgatgtttctctatggtagccaggaagacttgtgtgtgcttggctggtagtaatacaagaggtaacccgaggacagtttctgcacaatgaagttgtgccagtagagctccagaaaaatttctctctcctctgacctttatttaaagaagggacaacaagcaccttgacttctttccctttccttcttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaagtaaggtgatgacataaaattcatgctcaataggattacgctgaggcccaaccagggtgacagggtcacaagaggtccgttgactccttggggggctcttgggtgacttccctgaagtcctcagatgcccttgccctgtttcccatgagaggaaatgtggacatctagggtgcacattggttggcaaacactgcatgccaacaaccacctagtcccacaatggaaccttgggcatttctgtaaggatcgccccttgctcatgacaatgtcttttctggtgttttgcagtcatctcacatgccaccttggaaggcagagaaacacagataatcaggtaagtggtcagaacctggtaaagcctccacatcaaggtgacctcccccttcatggtttggctttcaattctcagtcagtctgtccttttagaatttggggacaacaaaatggtatgcaacggtaccaaaggagctcgatttaggatatgttctcccatgtagatcccctggtttgtaaagttttaaggaatgtgttcaactcccgataattgtttttttaattttcacctacagctcatggagagaggaggatgacattttttgaatattgtgatctcatactttgatgcttacaattccatggaaaatagctacaggaggacaagacaggccctgagggctttatgggaggctttctttcccatgagaggggaggcccaagtaacagagcctttcttaggaaaaaagaaggattctatgatatccaaaaaggctgtcctccccaggatgggttcacaaagggcaatccctctagcagatattctaaagatctcaccccagagacaatttacccatgtggataggatgagatattcatttttaccttggtgcccaccatattccaaatttccttcatggtatcatttagggcacttaatgaacctcactgcagaatcactgaggaaaaaaagctctacacattaggttgatacagggtaaggccaggtgtttaaagaacctaattccactttgattcataacaccaaggcctgacttgagtccagcaacattggttaccctcatgttttacagcagggcaacccataacaccttgacacaaatggatccatgtatagacatgggttctgtggcctgggcccaggattctcaggacattttccggaatcacctttcatgttgagtccggtcgaacaacatagactttacagagttctgatgccacatttgcactttgagcaaaaacacacagttactttaatcaccctcgtaatacctatctgtagttgttttattcaattattttttgtcttatccatagaacttgggcagctcaacttgagtgttgatacctacaaaattgtgaggctaaggtcacatgtgatgtggctgttgcttcgagaggaagcagtaaatctttattggaatccagggttcctttgtgtgtccactgatgtttctctatggtagccaggaagacttgtgtgtcctggtttggtagtaatacaagaggtaaccccaggaaatattctgcacaatgaagttgtgccagtagagctccagaaaaatgtctctctcctctgacctttatttaaagaagggacaacaagcgccttgacttctttccctttcctccttagggaagacattcttccaagtatcaagaaaaggagcccttgcaaccctggaagacattttctcctagcaatccctctccagttccatatgaccattcctactctgagccagttttggaaaggagggtgagtggttggattaggttaggtgatatccaagtagaggtagccgaattctgtctaggactgggtcaatgatgacaacccaatgtcttgaagataggtgatgacataaaattcatgctcaataggattacgctgaggcccaaccagggtgacagggtcacaagaggtccattgactccttggagggctcttgggtgacttccctgaagtcctcaaatgctcttgccctgtttcccatgagaggaaatgtggacatgtagggtgcacattggttggcaaacactgcatgccaacaaccacctagtcccacaatggaaccatgggcatttttgtaaggatcgttccttgctcatgacaatgtcttttctggtgttttgcagtcatctcacatgccaccttggaaggcagagaaacacagataatcaggtaagtggtcagaacatggtaaagcctccacatccaggtgacctcccccttcatgttttggctttcaattctcagtcagtctgtccttttagaaattggggataacaaaatggtatgcatgctaccaaaggagctcgatttaggctatgttctcccatgtagatcccctggtatgtaaagttttaaggaatgtgttcaactccagataattgttttttcataattttgacctacttcttatggagagaggaggatgacattttttgaatgttgggatctcatactttgatgcttacaattccatgccaaatagctacaggaggacaacacaggcccccagggctttatgggactcttcctttcccgtgacaggggaggcccaagtgacagagcctttcttagggaaaaagaaggattctatgatatccaaaaaggctgtcctccccaggatgggttcacaaaggacaatccctctagcagatattccaaagatctcaccccagagacaatttacccatgtggatagggtgagatattcatttttaccttggtgcacactccatttaaaatttccttcatgtatcatttagggcacttactgagcctcactgtagaatcactgaggaaaaaaatctctacacattaggttgatacagggtaaggccaggtgtttaaagaacctaattccactttgattcataacaccaaggcctgacttgagtccagcaacagtggttaccctcacgttttacaaaagggcaacccataacaccttgacacaaatggatccatgtatagacatgtgttctgtggcctgggcccaggattctcaggagattttcaggaatcacctttcagcttgactctggtcgtacaacatagacctgacagaggtctgatgccatatttgcactttgagcaaaaacacacagttactttaatcaccctcgaaatacctaactgtagttgttttattcaattattttttttcctatccagagaacttgggcagctcaacttgagtgttgatacctacaaaattgtgaggctaaggtcacatgtgatgtggctgttgcttcgagaggaagcagtaaatctttattggaatccagggttcctttgtgtgtccactgatgtttctctatggtagccaggaagacttgtgtgtgataggctggtagtaatacaagaggtaaaaccaggacagttactgcacaaggaagttgtgccagtagagctccagaaaaatgtctctctcctctgacctttatttaaagaagggacaacaagcgccttgacttctttccctttcctccatagggaagacattcttccaaatatcaagaaagggagcccttgcttccctggaggacatttcgtcccagcaatccctctccatttccatgtgaccattcctactctgagccagttttggaaagaaaggtaagtggttggattaggttaggtgatatccaagtagaggtagctgaattctgtctaggactgggtcaatgatgacaacacaatgtcatgaagaaaggtgatgacataaaattcatgctcaataggattacgctgaggcccaaccagggcgacagggtcacaagaggtcagttgactcctttgggggctcttgggtgacttccctgaagtcctcagatgcccttgccctgtttcccatgagaggaaatgtggacatctagggtacacattggttggcaaacactgcatgccaacaagcacctagtcccacaatggaaccatgggcatttctgtaaggatggtcccttgctcatgacaatgtcttttctggtgttttgcagtcatctcacatgccaccttggaaggcagagaaacacagataatcaggtaagtggtcagaatatggtaaagcctcctcatccaggtgacctaacccttcatgttttggctttcaattctcagtcagtctgtccttttagaatttggggataaaaaaatggtatgcaatgctaccaaaggagctcgatttaggctatgttctcccatgtagatcccctggtttgtaaagttttaaggaatgtgttcaactcccgataattgtttttttaattttcacctacagctcatggagagaggaggatgacattttttgaatattgtgatctcatactttgatgcttacaattccatggaaaatagctacaggaggacaagacaggccctgagggctttatgggaggctttctttcccatgagaggggaggcccaagtaacagagcctttcttaggaaaaaagaaggattctatgatatccaaaaaggctgtcctccccaggatgggttcacaaagggcaatccctctagcagatattctaaagatctcaccccagagacaatttacccatgtggataggatgagatattcatttttaccttggtgcccaccatattccaaatttccttcatggtatcatttagggcacttaatgaacctcactgcagaatcactgaggaaaaaaagctctacacattaggttgatacagggtaaggccaggtgtttaaagaacctaattccactttgattcataacaccaaggcctgacttgagtccagcaacattggttaccctcatgttttacagcagggcaacccataacaccttgacacaaatggatccatgtatagacatgggttctgtggcctgggcccaggattctcaggacattttccggaatcacctttcatgttgagtccggtcgaacaacatagactttacagagttctgatgccacatttgcactttgagcaaaaacacacagttactttaatcaccctcgtaatacctatctgtagttgttttattcaattattttttgtcttatccatagaacttgggcagctcaacttgagtgttgatacctacaaaattgtgaggctaaggtcacatgtgatgtggctgttgcttcgagaggaagcagtaaatctttattggaatccagggttcctttgtgtgtccactgatgtttctctatggtagccaggaagacttgtgtgtcctggtttggtagtaatacaagaggtaaccccaggaaatattctgcacaatgaagttgtgccagtagagctccagaaaaatgtctctctcctctgacctttatttaaagaagggacaacaagcgccttgacttctttccctttcctccttagggaagacattcttccaagtatcaagaaaaggagcccttgcaaccctggaagacattttctcctagcaatccctctccagttccatatgaccattcctactctgagccagttttggaaaggagggtgagtggttggattaggttaggtgatatccaagtagaggtagccgaattctgtctaggactgggtcaatgatgacaacccaatgtcttgaagataggtgatgacataaaattcatgctcaataggattacgctgaggcccaaccagggtgacagggtcacaagaggtccattgactccttggagggctcttgggtgacttccctgaagtcctcaaatgctcttgccctgtttcccatgagaggaaatgtggacatgtagggtgcacattggttggcaaacactgcatgccaacaaccacctagtcccacaatggaaccatgggcatttttgtaaggatcgttccttgctcatgacaatgtcttttctggtgttttgcagtcatctcacatgccaccttggaaggcagagaaacacagataatcaggtaagtggtcagaacatggtaaagcctccacatccaggtgacctcccccttcatgttttggctttcaattctcagtcagtctgtccttttagaaattggggataacaaaatggtatgcatgctaccaaaggagctcgatttaggctatgttctcccatgtagatcccctggtatgtaaagttttaaggaatgtgttcaactccagataattgttttttcataattttgacctacttcttatggagagaggaggatgacattttttgaatgttgggatctcatactttgatgcttacaattccatgccaaatagctacaggaggacaacacaggcccccagggctttatgggactcttcctttcccgtgacaggggaggcccaagtgacagagcctttcttagggaaaaagaaggattctatgatatccaaaaaggctgtcctccccaggatgggttcacaaagggcaatccctctagcagatattccaaagatctcaccccagagacaatttacccatgtggatagggtgagatattcatttttaccttggtgcacactccatttaaaatttccttcatgtatcatttagggcacttactgagcctcactgtagaatcactgaggaaaaaaatctctacacattaggttgatacagggtaaggccaggtgtttaaagaacctaattccactttgattcataacaccaaggcctgacttgagtccagcaacagtggttaccctcacgttttacaaaagggcaacccataacaccttgacacaaatggatccatgtatagacatgtgttctgtggcctgggcccaggattctcaggagattttcaggaatcacctttcagcttgactctggtcgtacaacatagacctgacagaggtctgatgccatatttgcactttgagcaaaaacacacagttactttaatcaccctcgaaatacctaactgtagttgttttattcaattattttttttcctatccagagaacttgggcagctcaacttgagtgttgatacctacaaaattgtgaggctaaggtcacatgtgatgtggctgttgcttcgagaggaagcagtaaatctttattggaatccagggttcctttgtgtgtccactgatgtttctctatggtagccaggaagacttgtgtgtgataggctggtagtaatacaagaggtaaaaccaggacagttactgcacaaggaagttgtgccagtagagctccagaaaaatgtctctctcctctgacctttatttaaagaagggacaacaagcgccttgacttctttccctttcctccatagggaagacattcttccaaatatcaagaaagggagcccttgcttccctggaggacatttcgtcccagcaatccctctccatttccatgtgaccattcctactctgagccagttttggaaagaaaggtaagtggttggattaggttaggtgatatccaagtagaggtagctgaattctgtctaggactgggtcaatgatgacaacacaatgtcatgaagaaaggtgatgacataaaattcatgttcaataggattacgctgaggcccaaccagggcgacagggtcacaagaggtcagttgactcctttgggggctcttgggtgacttccctgaagtcctcagatgcccttgccctgtttcccatgagaggaaatgtggacatctagggtacacattggttggcaaacactgcatgccaacaagcacctagtcccacaatggaaccatgggcatttctgtaaggatggtcccttgctcatgacaatgtcttttctggtgttttgcagtcatctcacatgccaccttggaaggcagagaaacacagataatcaggtaagtggtcagaatatggtaaagcctcctcatccaggtgacctaacccttcatgttttggctttcaattctcagtcagtctgtccttttagaatttggggataaaaaaatggtatgcaatgctaccaaaggagctcgatttaggctatgttctcccatgtagatcccctggtatgtaaagttttaaggaatgtgttcaactcccgataattgttttttcataattttgaccttcttctcatggagagatgaggatgacatttcttgaatgttgggatctcatactttgatgcttacaattccatggcaaatagctacaggaggacaacacaggcccccagggctttatgggactcttcctttcctgtgacaggggaggtccaagtgacagagcctttcttagggaaaaagaaggattctatgatatccaaaaaggctgtcctccccaggatgggttcataaagggcaatccctctagcagatattccaaagatctcaccccagagacaatttacccatgtggatagggtgagatattcatttttaccttggtgcacactccatttaaaatttccttcatgtatcatttagggcacctattgaacctcactgtagaatcactgaggaaaaaaagctctacacattaggttgatacagggtaaggacaggtgtttaaagaacctaattccactttgattcataacaccaagtcctgacttgagtccagcaacaggggttaccctcacgttttacagcagggcaacccataacaccttgacacaaatggatccatgtatagacatgggttctgtggcctgggcccaggattctcgggagattttcaggaatcacctttcagcttgagtcggtcgtacaacatatacctgacagaggtctgatgccacatttgcactttgagcgaaaacacacagttactttaatcaccctcgaaatacctaactgtagttgttttattcagttattttttgtcctatccatagaacttgggcagctcaacttcagtattgatacctacaaaattgtgaggctaaggtcacatgtgatgtggctgttgtttcgagaggaagcattaaatctttattggaatccagggttcctttgtgtgtccactgatgtttctctatggtagccaggaagacttgtgtgtgataggctggtagtaatacaagaggtaaccccaggacagtttctgcacaaggaagttgtgccagtagagctccagaaaaatgtctctctcctctgacctttatttaaagaagggacaacaagcgtcttgacttctttccctttcctccttagggaagacattcttccaagtatcaagaaagggagcccttgcttccctggaggacatttcgtcccagcgatccctctccatttccatgtgaccattcctactctgagccagttttggaaaggaaggtaagtggttggattaggttaggtgatatccaagtagaggtagccgaattctgtcttggactgggtcaatgatgacaacacaatgtcatgaagaaaggtgatgacataaaattcatgctcaataggattacgctgaggcccaaccagtgcgacagggtcacaagaggtccgttgactctttggggggctcttaggtgacatccctgaagtcctcagatgtccttgccctgtttcccatgagaggaaatgtggacatctagggtacacattggttggcaaacactgcatgccaacaagcacctagtcccacaatggaaccatgggcatttctgtaaggatcatcccttgctcatgacaatgtcttttctggtgttttgcagtcatctcacatgccaccttggaaggcagagaaacacagataatcaggtaagtggtcagaacatggtaaagcctccacatccaggtgacctcccccttcatgttttggctttcaattctcagtcagtctgtccttttagaatttggggataacaaaatggtatgcaatgctaccaaaggagctcgatttaggctatgttctcccatatagatcccctggtatgtaaagttttaaggaatgtgttcaactcccgataattgttttttcataattttgaccttcttctcatggagagaggaggatgacattttttgaatattgggatctcatactttgatgcttacaattccatggcaaatagctacaggaggtcaacacaggcccccagggctttatgggactcttcctttcccgtgacaggggaggcccaagtgacagagactttcttagggaaaaagaaggattctatgatatccaaaaaggctgtcctccccaggatgggttcacaaaaggcaatccctctagcagatattccaaagatctcacccaagagacaatttagccatgtggatagggtgagatattcatttttaccttggtgcccaccacatttaaaatttccttcatgtatcatttagggcacttactgaacctcactgcagaatcactgaggaaaaaaagctctacacattaggttgatacagggtaaggccaggtgtttaaaggacctaattccactttgattcataacaccaagtcctgacttgagtccagcaacagtggttaccctcacgttttacctcagggcaaccaataacaccttgacacaaatgcatccatgtataaacatgggttctgtggcctgggcccaggattctcgggatattttcaggaatcacctttcaggttgagtctggtcgtccaacatatacctgacagaggtctgatgccacatttgcactttgagcaaaaacacacagttactttaatcaccctggaaatacctaactctagttgtcttattcaattatgttttgtcctatccatagaacttgggcaactcaacttgaatgttgatacctacaaaattgtgaggctaaggtcacatgtaatgtggctgttgcttcgagaggaagcagtaaatctttattggaatccagggttcctttgtgtgtccactgatgattctctatggtagccaggaagacttttgtgtgctgggctggtagtaatacaagaggtaacccctggacagtttctgcacaatgaatttgtgccagtagacctccagaaaaatgtctctctcctctgacctttatttaaagaagggacaacaagcgccttgacttcattccctttcctcctttgggaagacattcttccaagtatcaagaaagggagccctagcttccctggaggacatttcgtcccagcgatccctctccatttccatgtgaccattcctactctgagccagttttggaaaggaaggtaagtggttggattaggttaggtgatatccaagtagaggtagccgaattctgtcttggactgggtcaatgatgacaacacaatgtcatgaagaaaggtgatgacataaaagtcatgctcaataggattacgctgaggcccaaccagggcgacagggtcacaagaggtccgttgactctttggggggctcttaggtgacatccctgaagtcctcagatgtccttgccctgtttcccatgagaggaaatgtggacatctagggtacacattggttggcaaacactgcatgccaacaagcacctagtcccacaatggaaccatgggcatttctgtaaggatcatcccttgctcatgacaatgtcttttctggtgttttgcagtcatctcacatgccaccttggaaggcagagaaacacagataatcaggtaagtggtcagaacatggtaaagcctccacatccaggtgacctcccccttcatgttttggctttcaattctcagtcagtctgtccttttagaatttggggataacaaaatggtatgcaatgctaccaaaggagctcgatttaggctatgttctcccatgtagatcccctggtatgtaaagttttaaggaatgtgttcaactcccgataattgttttttcataattttgaccttcttctcatggagagaggaggatgacattttttgaatattgggatctcatactttgatgcttacaattccatggcaaatagctacaggaggtcaacacaggcccccagggctttatgggactcttcctttcccgtgacaggggaggcccaagtgacagagactttcttagggaaaaagaaggattctatgatatccaaaaaggctgtcctccccaggatgggttcacaaaaggcaatccctctagcagatattccaaagatctcacccaagagacaatttagccatgtggatagggtgagatattcatttttaccttggtgcccaccacatttaaaatttccttcatgtatcatttagggcacttactgaacctcactgcagaatcactgaggaaaaaaagctctacacattaggttgatacagggtaaggccaggtgtttaaaggacctaattccactttgattcataacaccaagtcctgacttgagtccagcaacagtggttaccctcacgttttacctcagggcaaccaataacaccttgacacaaatgcatccatgtataaacatgggttctgtggcctgggcccaggattctcgggatattttcaggaatcacctttcaggttgagtctggtcgtccaacatatacctgacagaggtctgatgccacatttgcactttgagcaaaaacacacagttactttaatcaccctggaaatacctaactctagttgtcttattcaattatgttttgtcctatccatagaacttgggcaactcaacttgaatgttgatacctacaaaattgtgaggctaaggtcacatgtaatgtggctgttgcttcgagaggaagcagtaaatctttattggaatccagggttcctttgtgtgtccactgatgattctctatggtagccaggaagacttttgtgtgctgggctggtagtaatacaagaggtaacccctggacagtttctgcacaatgaatttgtgccagtagagctccagaaaaatgtctctctcctctgacctttatttaaagaagggacaacaagcgccttgacttcattccctttcctcctttgggaagacattcttccaagtatcaagaaagggagccctagcttccctggaggacatttcgtcccagcgatccctctccatttccatgtgaccattcctactctgagccagttttggaaaggaaggtaagtggttggattaggttaggtgatatccaagtagaggtagccgaattctgtcttggactgggtcaatgatgacaacacaatgtcatgaagaaaggtgatgacataaaattcatgctcaataggattacgctgaggcccaaccagggcgacagggtcacaagaggtccgttgactctttggggggctcttaggtgacatctctgaagtcctcagatgtccttgccctgtttcccatgagaggaaatgtggacatctagggtacacattggttggcaaacactgcatgccaacaagcacctagtcccacaatggaaccatgggcatttctgtaaggatcatcccttgctcatgacaatgtcttttctggtgttttgcagtcatctcacatgccacattggaaggcagagaaacacagataatcaggtaagtggtcagaacatggtaaagcctccacatccaggtgacctcccccttcatgttttggctttcaattctcagtcagtctgcccttttagaatttggggataacaaaatggtatgtaatgctaccaaaggagctcgatttaggctatgttctcccatgtagatcccctggtatgtaaagttttaaggaatgtgttcaactcccgataattgttttttcataattttgaccttcttctcatggagagaggaggatgacattttttgaatattgggatctcatactttgatgcttacaattccatggcaaatagctacaggaggtcaacacaggcccccagggctttatgggactcttcctttcccgtgacaggggaggcccaagtgacagagactttcttagggaaaaagaaggattctataatatccaaaaaggctgtcctccccaggatgggttcacaaaaggcaatccctctagcagatattccaaagatctcacccaagagacaatttagccatgtggatagggtgagatattcatttttaccttggtgcccaccacatttaaaatttccttcatgtatcatttagggcacttactgaacctcactgcagaatcactgaggaaaaaaagctctacacattaggttgatacagggtaaggccaggtgtttaaaggacctaattccactttgattcataacaccaagtcctgacttgagtccagcaacagtggttaccctcacgttttacctcagggcaaccaataacaccttgacacaaatgcatccatgtataaacatgggttctgtggcctgggcccaggattctcgggatattttcaggaatcacctttcaggttgagtctggtcgtccaacatagacctgacagaggtctgatgccacatttgcactttgagcaaaaacacacagttactttaatcaccctggaaatacctaactctagttgtcttattcaattatgttttgtcctatccatagaacttgggcaactcaacttgaatgttgatacctacaaaattgtgaggctaaggtcacatgtaatgtggctgttgcttcgagaggaagcagtaaatctttattggaatccagggttcctttgtgtgtccactgatgattctctatggtagccaggaagacttttgtgtgctgggctggtagtaatacaagaggtaacccctggacagtttctgcacaatgaatttgtgccagtagagctccagaaaaatgtctctctcctctgacctttatttaaagaagggacaacaagcgccttgacttcattccctttcctcctttgggaagacattcttccaagtatcaagaaagggagccctagcttccctggaggacatttcgtcccagcaatccctctccatttccatgtgaccattcctactctgagccagttttggaaaggaaggtaagtggttggattaggttaggtgatatccaagtagaggtagctgaattctgtctaggactgggtcaatgatgacaacacaatgtcatgaagaatggtgatgacataaaattcatgctcaataggattacgctgaggcccaaccagggcaacagggtcacaagaggtccgttgactcctttgggggctcttgggtgacttccctgaagtcctcagatgcccttgccctgtttcccatgagaggaaatgtggacatctagggtacacattggttggcaaacactgcatgccaacaagcacctagtcccacaatggaaccatgggcatttctgtaaggatcgtcccttgctcatgacaatgtcttttctggtgttttgcagtcatctcacatgccaccttggaaagcagagaaacacagataatcaggtaagtggtcagaacatggtaaagcctccacatccaggtgacctaccccttcatgttttggctttcaattctcagtcagtctgtccttttagaatttggggataacaaaatggtatgcaatgctaccaaaggagctcgatttaggctatgttctcccaagtagatcccctggtatgtaaagttttaaggaatgtgttcaactcccgataattgttttttcataattttgaccttcttctcatggagagaggaggatgacatttcttgaatgttgggatctcatactttgatgcttataattccatggcaaatagctacaggaggacaacacaggcccccagggctttatgggacttttcctttcccgtgacaggggaggcccaagtgacagagcctttcttagagaaaaagaaggactctatgatatccaaaaaggctgtcctccccaggatgggttcacaaagggcaatccctctagcagatattccaaagatctcacccaagagacaatttacccatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacatcaaggcctgacttgagtccaacaacagtggttaccctcacgttttacagcagggcaacccataactcctttacacaaatggatccatgtaatgacattggttctgtggcctgggcccaggattctcaggagattttcaggaatcacctttcaggttgagtctggtcgtccaacatagacctgacagaggtctgatgccacatttgcactttgagcaaaaacacagttacgttaatcaccctcgaaatacctaactgtagttgttttattcaattatttttgtcctatccatagaacttgggcagctcaacttgagggttgatacctaaaaattgtgaggctaaggtcacatgtgatgtggctgttgctttgagaggaagcagtaaaactttattagaataccagggttcctttgtgtgtcctctgatgtttctctatggtagtcaggaagacttgtgtttgctgggctggtagtaatacaagaggaaaccccaggacagtttctgcacaatgaagttgtgccagtagagctccagaaaaatgtctctctcctctgacctttatttaaagaagggacaacaagcgccttgacttctttccctttcctccttagggaagacattcttccaagtatcaagaaagggagcccttgcttccctggaagacatttcgtcagagcaatccctccccagttccgtgtgaactttcctactctgagccagttttggaaaggaaggtaagtggttggattaggttaggtgatatccaagtagaggtagctgaattctgtctaggactggatcaatgatgacaaaccaatgtcatgaagaaatgtgatgacataaaatttatgctcaataggattacgctgaggcccaaccagggtgacagggtcacaaaaggaccattgactcctagggaggggctcttgggtgacttccctgaagtcctcagatgcccttgccctgtttcccatgagaggaaatgtggacatctatggtgcacattggtttgcaaacactgcatggcaacaagcacctagtcccacaatggaaacatgggcatttctgcaaggatcgccccttgctcgtgacaatgtcttttctggtgttttgcagtcatctcacatgccaccttggaagtcagagaaacacagataatcaggtaagtggtcagaacatggtaaagcctccacatccaggtgacctcccccttcatggtttggctttcaattctcagccagtctgtccttttggaatttggggataacaaaatggtatgcaatggtaccaaaggagctcatttaggctatgttatcccatgtagatcctctggtttgtaaagttttaaggaatgtgatcaactcctgataattgttttttcataattttgacctacttctcatggagaggaggatgaaattttttaatgtttagatctcatactttgatgcttacatttccatggcaaatagctacaggaggtcaacacaggcctccagggacttattggacacttcctctctcttgactgtaaggcccaagtgacagaacctttcttagggaaaaagaaggattctatgatatccaaagaggctgtcctccccaggatgggttcaaaaagggcaatccctctagcagatattccaaagatctcaccccagagacaatttatccatgtgggtaggttgagatattcatttttaacttggtgcccaccacattccaaatttccttcatggtatcatttgggcacttactgaacctcactacagaatcactgaggaaaaatatctctacacattaggttgatacagggtaaggccaggtgtttaaagaacctatttccactttcattcataacaccaaggcctgactagagtccagcaacagtggttaccctgacgttttacagcagggcaacccataacttcttgacacaaatggatccatttatggacattggttctgtcgtctggcccaggattctcaggagattttcaggaataacctttcacgttgagtggggtcttacaacatagaccttacagaggtctgatgccacaattgcactttgagcaaaaacacacagttactttaatcaccctcgaaatacctatctgtagttgttttatttaattatttttcttcgtcctatccatagaaattgggcagttcaacttgagtattgatacctacaaaattgtgaggctaaggtctcatgtgatgtggctgttgcttagagaggaagcagtaatctttattggaatccagggttcctttgtgtgtccactgatgtttctctatcgtagccaggaagacttgtgtgtgctgggctggtagtaatacaagaggtacccccaggacagtttctgcacaatgaagttgtgccagtagagctccagaaaaatgactctcccctctgacctttacttaaagaagggacaacaagcgccttgacttctttccatttcctccttagggaagacattcttccaagtatcaagaaagggagcccttgcttccctggaagatattacgtcccagcaattcctctccagttccatgtgaccattcctactctgaaccagtttttgaaaggaaggtaagtagttggattaggttaggtgatatccaagtagaagtagccgaattctgtctaggtctgggtcaatggtgacaacccaatgtcatgaagaaagttgatgacataaaattcatgctcaataggattatgctgaggcccaaccagtgcgacagggtcaaaagaggtcagttgactccttggggggggctcttgggtgacttccctgaagtcctcagatgccctttccctgtttcccatgagaggaaatgtggacatctagggtgcactttcgttggcaaacactgcatgccaacaaacacctagtcccacaatggaaccttgggcatttctgcaaaggtcgtcccttggccatgacaatgccttttctggtgttttgcagtcatctcacatgccaccttggaaggcagagaaatacagataatcaggtaagtggtcagaacatggtaaagcctccacatccaggtgacctcccccttcatgttttggctttcaattctcagccaggctgtccttttagaatttggggataacaaatttatgaaacagtacaaaaggagctcgatttaggatatgttctcccatgtagatcccctagtttgtaaagttttaaggaatgtgttcagctcccgataattgttttttcataattttgacctacttctcatggagagaggaggatgacatttcttgaatgttgggatctcatactttgatgcttacaattccattggaaaaagctacaggaggacaacacaggcctccagggccttatgggacttttcctttcccgtgacaggggaggcccaagtgacagagcctttcttagggaaaaagaaggattctatgatatccaaaaaggctgtcctccccaggatgggttcacaaagggcaatccctctagcagatattccaaagatctcacccaagagacaatttacccatgtggatagggtgagatattcatttttaccttggtgcccaccacattccaaatttaattcatggtatcctttagggcacttactgaacctcactgcagaatcactgaggaaaaaaagctctacacattaggttgatacagggtaaggccaggtgtttaaagaacctaattccactttgattcataacaccaaggcctgacttgagtccagcaaaagtggttaccctcacattttacagcagggcaacccataacaccttgacacaaatggatccatgtatagacatgggttctgtggcctgggcccaggattcttgggagattttcaggaatcacctttcaggttgagtctggtcgtacaacatagacctgacagaggtctgatgccacatttgcactttgagcaaaaacacacagttactttaatcaccctcgaaatacctaactgtagttgttttattcaattatttttgtcctatccatagaacttgggcagctcaacttgagggttgatacctaaaaattgtgaggctaaggtcacatgtgatgtggctgttgcttcgagaggaagcagtaaaactttattagaataccagggttcctttgtgtgtcctctgatgtttctctatggtagccaggaagacttgtgtttgctgggctggttgtaatacaagaggaaaccccaggacagtttctgcacaatgaagttgtgccagtagagctccagaaaaatgtctctctcctctgacctttatttaaagaagggacaacaagcgccttgacttctttccctttcctccttagggaagacattcttccaagtatcaagaaagggagcacttgcttccctggaagacatttcgtcagagcaatccctccccagttccatgtgaactttcctactctgagccagttttggaaaggaaggtaagtggttggattaggttaggtgatatccaagtagaggtagcccaattctgtctaggactggatcaatgatgacaaaccaatgtcatgaagaaatgtgatgacataaaatttatgctcaataggattacgctgaggcccaaccagggtgacagggtcacaaaaggaccattgactcctagggaggggctcttgggtgacttccctgaagtcctcagatgcccttgccctgtttcccatgagaggaaatgtggacttctatggtgcacattggtttgcaaacactgcatggcaacaagcacctagtcccacaatggaaacatgggcatttctgcaaggatcgccccttgctcgtgacaatgtcttttctggtgttttgcagtcatctcacatgccaccttggaagtcagagaaacacagataatcaggtaagtggtcagaacatggtaaagcctccacatccaggtgacctcccccttcatggtttggctttcaattctcagccagtctgtccttttggaatttggggataacaaaatggtatacaacggtaccaaaggagctcatttaggctatgttatcccatgtagatcctctggtttgtaaagttttaaggaatgtgatcaactcctgataattgttttttcataattttgacctacttctcatggagaggaggatgaaattttttaatgtttagatctcatactttgatgcttacatttccatggcaaatagctacaggaggtcaacacaggcctccagggacttattggacacttcctctctcttgactgtaaggcccaagtgacagaacctttcttagggaaaaagaaggattctatgatatccaaagaggctgtactccccaggatgggttcaaaaagggcaatccctctagcagatattccaaagatctcaccccagagacaatttatccatgtgtataggttgagatattcatttttaacttggtgcccaccacatttaaaatttccttcatggtatcatttgggcacttactgaacctcactgcagaatcactgaggaaaaatatctctacacattaggttgatacagggtaaggccaggtgtttaaagaacctatttccactttcattcataacaccaaggcctgactagagtccagcaacagtggttaccctgacgttttacagcagggcaacccataacttcttgacacaaatggatccatttatggacattggttctgtcgtctggcccaggattctcaggagattttcaggaatcacctttcacgttgagtggggtcttacaacatagaccttacagaggtctgatgccacaattgcactttgagcaaaaacacacagttactttaatcaccctcgaaatacctatctgtagttgttttatttaattattttttttcgtcctatccatagaaattgggcagttcaacttgagtgttgatacctacaaaattgtgaggctaaggtctcatgtgatgtggctgttgcttagagaggaagcagtaatctttattggaatgccagggttcctttgtgtgtccactgatgtttctctatcgtagccaggaagacttgtgtgtgctgggctggtagtaatacaagaggtacccccaggacagtttctgcacaatgaagttgtgccagtagagctccagaaaaatggctctcccttctgacctttacttaaagaagtgacaacaagcgccttgacttctttccatttcctccttagggaagacattcttccaagtatcaagaaagggagcccttgcttccctggaagacattacatcccagcaattcctctccagttccatgtgaccattcctactctgaaccagtttttgaaaggaaggtaagtagttggattaggttaggtgatatccaagtagaagtagacgaattctgtctaggtctgggtcaatggtgacaacccaatgtcatgaagaaagttgatgacataaaattcatgctcaataggattacgctgaggcccaaccagtgcgacagggtcaaaagaggtcagttgactccttgggggggctcttggatgacttccctgaagtcctcagatgccctttccctgtttcccatgagaggaaatgtggacatctagggtgcacattggttggcaaacactgcatgccaacaaacacctagtcccacaatggaaccttgggcatttctgcaaaggtcgccccttggccatgacaatgccttttctggtgttttgcagtcatctcacatgccaccttggaacgcagagaaatacagataatcaggtaagtggtcagaacatgataaagcctccacatccaggtgacctcacactctttggtttggctttcaattctcagccaggctttccttttggaatttggggataacaaatttacgcaacagtacaaaaggagctcgatttaggatatgttctcccatgtagatcccctagtttgtaaagatttaaggaatgtgttaagctcccgataattgttttttcataattttgacctacttctcatggagagaggaggatgacattttttaatgtttagatctcatactttgatgcttacatttccatggcaaatagctacaggaggtcaacacaggcctccagggacttattggacacttcctctctcttgactgtaaggcccaagtgacagagcctttcttagggaaaaagaaggattctatgatatccaaagaggctgtcctccccaggatgggttcaaaaagggcaatccctctagcagatattccaaagatctcaccccagagacaatttatccatgtggatagggtgagatattcatttttaacttggtgcccaccacattccaaatttccttcatggtatcatttgggcacttactgaacctcactgcagaatcactgaggaaaaatatctctacacattaggttgatacagggtaaggccaggtgtttaaagaacctaattccactttcattcataacaccaaggcctgacttgagtccagcaacagtggttacactgacgttttacagcagggcaacccataactccttgacacaaatggatccatttatggacattggttctgtcgtctggcccaggattctcaggagattttcaggaatcacctttcacgttgagtggggtcttacaacatagaccttacagaggtctgatgccacaattgcactttgagcaaaaacacacagtttctttaatcaccctcgaaatacctatctgtagttgttttatttaattattttttttcgtcctatccatagaaattgggcagctcaacttgagtgttgatacctacaaaattgtgaggctaaggtctcatgtgatgtggctgttgcttagagaggaagcagtaatctttattggaatgccagggttcctttgtgtgtccactgatgtttctctatggtagccaggaagacttgtgtgtgctgggctggtagtaatacaataggtacccccaggacagtttctgcacaatgaagttgaaccagtagagctccagaaaaatgactctcccctctgacctttacttaaagaagtgacaacaagcgccttgacttctttccatttcctccttagggaagacattcttccaagtatcaagaaagggagcccttgcttccctggaagacattacatcccagcaattcctcaccagttccatgtgaccattcctactctgaaccagtttttgaaaggaaggtaagtagttggattaggttaggtgatatccaagtagaatgagccgaattctgtctaggtctgggtcaatggtgacaacccaatgtcatgaagaaagttgatgacataaaattcatgctcaataggattacgctgaggcccaaccagtgcgacagggtcaaaagaggtcagttgactccttgggggggctcttggatgacttccctgaagtcctcagatgccctttccctgtttcccatgagaggaaatgtggacatctagggtgcacattggttggcaaacactgcatgccaacaaacacctagtcccacaatggaaccttgggcatttctgcaaatgtcgccccttggccatgacaatgccttttctggtgttttgcagtcatctcacatgccaccttggaacgcagagaaatacagataatcaggtaagtggtcagaacatggtaaagcctccacatccaggtgacctcacactctttggtttggctttcaattctcagccaggctttccttttggaatttggggataacaaatttacgcaacagtacaaaaggagctcgatttaggatatgttctcccatgtagatcccctagtttgtaaagatttaaggaatgtgttaagctcccgataattgttttttcataattttgacctacttctcatggagagaggaggatgacattttttaatgtttagatctcatactttgatgcttacatttccatggcaaatagctacaggaggtcaacacaggcctccagggacttattggacacttcctctctcttgactgtaaggcccaagtgacagagcctttcttagggaaaaagaaggattctatgatatccaaagaggctgtcctccccaggatgggttcaaaaagggcaatccctctagcagatattccaaagatctcaccccagagacaatttatccatttggatagggtgagatattcatttttaacttggtgcccaccacattccaaatttccttcatggtatcatttgggcacttactgaacctcactgcagaatcactgaggaaaaatatctctacacattaggttgatacagggtaaggccaggtgtttaaagaacctaattccactttcattcataacaccaaggcctgacttgagtccagcaacagtggttacactgacgttttacagcagggcaacccataactccttgacacaaatggatccatttatggacattggttctgtcgtctggcccaggattctcaggagattttcaggaatcacctttcacgttgagtggggtcttacaacatagaccttacagaggtctgatgccacaattgcactttgagcaaaaacacacagtttctttaatcaccctcgaaatacctatctgtagttgttttatttaattattttttttcgtcctatccatagaaattgggcagctcaacttgagtgttgatacctacaaaattgtgaggctaaggtctcatgtgatgtggctgttgcttagagaggaagcagtaatctttattggaatgccagggttcctttgtgtgtccactgatgtttctctatggtagccaggaagacttgtgtgtgctgggctggtagtagtacaagaggtaaccccaggacagtttctgcacaatgaacttgtgccagtagagctccagaaaaatgactctcccctctgaactttatttaaaaaagggactacaagcgccttgacttctttcccttttctccttagggaagacattcttccaagtatcaagaaagggagcccttgcttcctgggaagacatttcgtcccagcaatccctctccagttccatgtgaccattcctactctgagccagttttggaaaggaaggtaagtggttggattaggttaggtgatatccaagtagaggttcccgaattctgcctagaactgggccaatgatgacaaccaaatgtcatgaagaaatgtgatgacataaaattcatgctcaataggattacgctgaggtccaaccagggcaacagggtcacaagaggtcccttgactccttggggggctcttgggtgacttccctgaagtcctcagatgcccttgccctgtttcccatgagaggaaatgtggacatctatggtgcacattcgttggcaaacactgcatgccaacaagcacctatcccacaatggaaccttgagcatttctgcaaggatcgccccttgctcatgacaatgtcttttctggttttttgcagtcatctcacatgccacctaggaaggcagagaaacacagataatcaggtaagtggtcagaacatggtaaagcctccacatccaggtgacctcccccttcatgatttggctttcaattctcagccagtctgaccttttgggttttggggataccaaaatggtatgcaacggtaccaaaggagctcgatttaggctatgttctccaatgtagatcccctggtatgtaaagttttaaggaatgtgttcaactcccgataattgttttttcataattttgacctacttctcatggagagaggaggatgacattttttgaatgttgggatctcatactttgatgcttacaattccatggcaaatagctacaggaggacaacacaggcccccagggctttatgggacttttcctttcccttgacaggggaggcccaagtgacagagcctttcttagggaaaaagaaggatctataatatccaaaaagactgtccttcccaggataggttcacaaagtacaatccctctagcagatattcgaaagatttcaccccagagacaatttacccatgtggatagggtgagatattcgtttttaccttggtggccaccacattccaaatttccttcatggtatcattcagggcacttactgaacctcactgcagaatcactgaggaaaaaaagctctacacattaggtttatacagggtaaggccaggtgtttaaaggacctaattccactttgattcataacaccaaggcctgacttgagtccagcaacagtggttaccctcatgttttacagcagggcaacccataaaaacttgacacaaatggatccatgtatagacattggttctgtggcctgggcccaggattctcaggaaattttcaggaatcacctttcacgttgagtggggttgtacaacatagaccttacaaaggtctgatgacacatttacaccttgagccagaacccacagatactttaatcaccctcgaaatacctatctgtagttgttttatttaattatttttttttttttgttctatccatagaacttggtgaattcaactttgtgttgatccctaaaaattgtgaggctaaggtcacatgtgatgtggctgttgctttgagaggaagcagtaaaattttattggaataccagggttcctttgtgtgtccactgatgtttctctaaggtagccaggaagacttgtgtttgctgggctggtagtaatacaagaggaaacccaggacagtttctgcacaatgaagttgtgccagtagagctcctgaaaaatgtctctctcctctgacctttatttaaagaagggacaacaagcgccttgacttctttccctttcctccttagggaagacattcttccaagtatcaagaaagggagcccttgcttccctggaagacatttcgtcagagcaatccctccccaattccgtgtgaactttcctactcggagccagttttggaaaggaaggtaagtggttggattaggttaggtgatatccaagtagaggtagccgaaatctgtctaggactgggtcaatgatgacaaactgatgtcatgaagaaatgtgatgacataaaatttatgctcaataggattacgctgaggcccatccatggtcacagggtcacatgaggaccattgactccatggggtggctcttgtgtgacttccctgaagtcctcagatgcccttgccctgtttcccatgagaggaaatgtggacatctatggtgcacattggtttgcaaacactgcatggcaacatgcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatggtttggctttcaattctcagccagtctgtccttttggaatttggggataccaaaatggtatgcaacggtaccaaaggagctcgatttaggctatgttatcccatgtagatcctctggtttgtaaagttttaaggaatgtgatcaactcccgataattgttttttcataattttgacctacttctcatggagagaggaggatgacattttttgaatgttgggatctcatactttgatgcttacatttccatggcaaatagctacaggaggtcaacacaggcctccagggccttattggacacttcctttcccttcacactaaggcccaagtgacagaacctttcttagggaaaaagaaggattctatgatatccaaagaggctgtcctccccaggatgggttcaaaaagggcaacccctctagcagatattccaaagatctcaccccagagccaatttacccatgtggatagggtgagatattcatttttaccttggtgcccaccacattccaaatttccttcatagtgtcatttagggcacttactgaacctcactgcagaatctctgaggaaaaaaacctctacacattaggttgatacagggtaagtccaggtgtttaaagaacctaattccactttgattcataacaccaaggcctgacttgagtccaacaacagtggttaccctcacgttttacagcagggcaacccataactcctttacacaaatggatccatgtaatgacattggttctgtggcctgggcccaggattctcaggagattttcaggaatcacctttcacgttgagtggggtcgtacaacatagaccttacagaggtttgatgacacatttacactttgagcaagaacccacagatactttaatcaccctcgaaatacctatctgtagttgttttatttaattattttttttgtcctatccatagaactaggtcagctcaacttgattgttgatctctacaaaattgtgaggctaaggtcacatgtgatgtggctgttgcttcaagaggaagcagtaaatctttattggaatccagggttcctttgtgtgtccactgatgtttctctatggtagccaggaagacttgtgtgtgctgggctggtagtaatacaagaggtaaccccaggacagtttctgcacaatgaagttgttccagtagagctccagaaaaatgtctctctcctctgacctttatttaaagaagggacaacaagcgccttgacttctttccctttcctccttagggaagacattcttccaagtatcaagaaagggagcccttgcttccctggaagacatttcgtcagagcaatttctccccagttccgtgtgaccattcatactctgagccagttttggaaaggaaggtaagtggttggattaggttaggtgatatccaagtagaggtagccgaattctgtctaggactgggtcaatgatgacaacccaatgtcatgaagaaatgtgatgacataaaatttatgctcaataggattacgctgagtcccaaccagggtgacagggtcaaaagaggtccattgactccttggggggctcttgaagtcctcagatgcccttgccctgtttcccatgagaggaaatgtggacatctagggtgcacattggtttgcaaacactgcatgccaacaagcacctagtcccacaatggaaccatgggcatttctgcaaggatcgccccttgctcatgacaatgtcttttttggtgttttgcagtcatctcacatgccaccttggaaggcagagaaacacagataatcaggtaagtggtcagaacatggtaaagcctccacatccaggtgacctcccccttcatggtttggctttcaattctcagccagtctgtttttttggaatttggggataacaaaatggtatgcaatggtaccaaaggagctcgatttaggctatgttctcccatgtagatcccctggtttgtaaagttttaaggaatgtgttcaactaccgataattgttttttcataattttgacatacttctcatggagagaggaggatttcatttcttaatgttgagatctcatactttgatgcttacatttccatggcaaatagctacaggaggtcaacactggcctccagggacttatgggacacttcctttcccttgacagggaggcccaagtgacagagcctttcttagggaaaaagaaggaatctatgatatccaaaaaggctgtcctccccaggatgggttcacaaagggcaatccctctagcagatattccaaagatctcaccccagagacaatttacccatgtggattgggtgagatattcgtttttaccttggtggccaccacattccaaatttccttcatggtatcatttagggcacttactgaacctcactggagaatcactgaggaaaaaaagctctacacattaggttgatacagggtaaggccaggtttttaaagaacctaattccactttcattcataataccaaggcctgacttaagtccagcaactgtgcttaccctcctgttttacagcagtgcaactcataacaccttgaaacaaatggatttatgtatagacattgtttctgtggcctgggcccaggattctcgggagattttcaggaatcacctttcacattgagtggtgttgtgcaacctagaccttatagagttctgatgacacatttacaccttgagccagaacccacagatactttaatcatcctcgaaatacctatctgtagttgttttatttaattatttttttgtcctatctatagaacttcggcagcacaacttgagtgttgatcccaaaaaatcgttgggctaaggtcacatgtgatgtggctggtgcttcaagaggaagaagtaaatcattattggaatgccagggttcctttgggcttccacagatatttctctatggtagccgggaagacttttgtgtgctgggctggtagtaatacaagaggcaaccacaggacagtttctgcacaatgaagttgtgccattagagctccagaaaaatgtctctaccctctgacctttatttaagaagggacaacaggtgccttgacttctttccctttcctccttagggaagacattcttccaagtatcaagaaagggagcccttgcttccctggaagacatttcgtccctgcatccctcttacgttccatatgatcattcctactctgaggcagttttaaaaaggaaggaaagtggttggattaggttagctgatatccaagtacagctaactgtatcctgtctaggcctgggtcaataatggcaatccaatgtcatgaagaaaggtgatgacataaaattcatgctcaataggattactctgaggcccaaccagggcgacagggtcacaagaggtctgttgactccttgggggggctcttgggtgacttccctgatgtcctcagatgcccttgccctgttttccatgagaggaaatgtggaaataggtacaggtggaaaacacaggcctccatggccttatgggactcttcctttcccttgacattggaggcccaagggacagagcctttcttagggagaaagaaagattctatggtatccaaaaaggttgtcctccacatggtgggttcacaaagtgcaatccctcgagccaatgtcatgaagaaaggtgatgacataaaattcatgctcaataggattatgctgaggcccaaccctggagacagggtcacaagaggtccgttgactccttggtgggctcttggttgacttcctttaggtcctcagatgcccttgccctgtttcccatgagaggaatgtacatgtgaagagaggtgatgtcatatgattcatgctcaataggattatactgaggccctaccacggagacaggtttacaagaggtctgttgactctctggagtgctcttggatgacttccttgtagtcctcagatgccactaccctgtttctcatgagaagaaatgtggatatctagggtgcacattggtttgcaaacactctatgccaacaagcacctaatcctacaatggaaccttggttatttctgcatagaagaccattcgctcatttccctgtcttttctggtgttttgtagtcatctcacatgccaccttggaaggcagagaactgcagataatcaggttagtgttaagaacatggtaaagcctccacctctaggtgacctgccccttatgttttggctttcaattctgagccaccctgcccttttggaatttgggaatagcaaaatcctatgcaatggtaggcaatgaagctggatttatgctatgttctcccaggtagtccccctggtttgtaaaggtttaagaaatgcattcaattcccaataattattttctcataatttcgacctacttctcatggggagaagaggatgacatttttaggatgttgggatctcatactttggtacttacaaggccatggtgaatagttacaggaggacaatgcaagctcccaggcccatatatgaggcttactttcccatgacataggaggcctaagacacagaacctttcttactgagagaggaggattctatgatatcctacaaggctggcctccacatgatgtgttcacaaagggcaaaccctcaagcaattattgcaaagatatcactccagagggaatttactcatgtgtactgggtgtgattttcatttttacgtttgttccctccatcttccaaatttccttcatggtatcatttaaggcacttactaaacctcactgtagaatcactgaggaaacaaaggcctacacatttggttgaaacagggaaggcccaggtgtttaaagaacctaattccactctgattcataacaccaaggcctgacttgaatccagcaacattggttaccctcacgtttgagaggttgggcaacccataataccttgacacaaatggatccatgtatagagattggttctgtggcctcggccctgaattctagggagattttcagtaatcacattttacagtgagtgctgtcatgcaacagagagcttacagaggtctgatgctatatttgcactttgaagaagaacccagtcgttactttagtcaccctcgaaatacctactgtagatgtgttttattgtcatgtctataagtgcttgggcagctcaacttgagtgttgatccctacaaaattgggaggctaaggtcacatttgatgtggctattgcttcaagaggaagcagtaaatctttgttggaatgccagggctcctttgtgcttccattgatatttctgtatggtagccatgacaacttttgtgtgctgggcccggtagtaatagatgaggcaaccacaagacagtttctgcacaatgaaattgcaccagtagtgccccagaaaaatgtctctcacctctgacctttatttaaaaaatacaacaaaagccttgatttcctttcctttactccttagggaagacattcttccaagtttcaagaaagggtgcccttgcttctctggaaggcctttcatccctgtatccctctccagttccttgtgaccattcctaactctgaggcagttttggaaaggaaggtaagtggttggattaggttacatgatgtgcaagtaaaggtagccgtgttctgactagagagaagaggatgacatttttagaatgttggtgtctcataccttgatacttatgtggccatggtaaataggtacaggatgacaacacaggactccagggccatttgggactcttcccttcccatgagaaaggagctcgaagggacatagccttttttagggatagagaagctctctatgatatccaaaagagctttcctccacatgatgtcatcctttgagtaaatatttcaaagatcataccccacagggaatttacccatgtggataggatgagattttcactgttgccttggttcccaccactttcctaatttccttcatggtatcatttagggctcttactgaacctctctgtagaatcaccaacgaaacaggggcttatacattaggttgatagagggaaggccaggtgtaaggaaccaaattgcactctgattcatgacaccaaggcaggagttggatccagtaacagttgttaccttcatgttttagaggttgggcaactaattacagcttaacaccaatggatccatggctagacatttgtcttgtgtcccaggaccatgattcttgggagattttaagcaatcacatttcacagtgagtgctgtcatgcaacatagagcttgcagaggtctgatgctaccttttcactttgaataagaacccattggttactttaatcacactcaaaatacctatctgtagttgtgaattattttcctgtccaaaatactgggggagctcaacttgaatgttgatcacttccaaattgtgaggctaaggtcacatgtgatgttgctattgcttctagaggaagcagtaaatctttgtttgaatgtcagtggtcctttttgctttcatcgatgtttctctgtggtagccatgaaaccctgtgggtgttgacccttctactaatagatgatgcagccacaagacatgttctgcacaatgaaatttttccataagagctccactaaaacttctcgcacctctgacatttatgtaaaaaggatacaacaggtctcttgacttctttccctttcctccttagggaagacatctttcaagtttcaagcaagggtgcttttgctccctggaagacgtttcttctctgcatccttcttaagttacatgtgaccattcctctctctgaggctgtttttgtaaggatggtatgcagttgggttaggttaggtgatatcaatgtacagtcagccattttctgtctaggcctttgtcaatgataacaacccaaaatcatgaacagaggtgatgatataaaaatcatgctcaataggattacgctgaggcacaaagaactgggttacaagcagtcacttgacacattggaaacctctttggtgacttcaatgaggtcctcagatgcctgtgccttctttttcaagagaggaaatgtggacatctatggtgtacattggttggcaaatgctgcatgacaacaagcacctagtcccacattctaaccttgggcatttctgaaaggcctgcccattgctcatgaccctgtcctttctggtgttttgcaatcatctgacatgccaccttgtaaggcagagaaacacagatatcaggtaagtgaaaaagatcatggctaaagcctccccttccatgtgaccagctccttcatgtctttgctctcaattctgagccagtctgcccttttggaataacaaaatggtatgcaatggtacctaacaaatctcgatttaggctctgttatcccttgtagacctgctgttttgcaaacctttaaggaatttgttcaactcccaataatttttttctcatagttttgacctacttcttatggatagaagtggaagacaattttggaatgttgggatctcaaacttgaattattacatgtccatggcaaataagtactggatatcaacacaagcttccagggctcattgagacttttcatatcccatgacataggaggcccaaggaacaaagcctttcttaaggagagcgaagtattctatgatatgcaacagggctggcttccacatgatgtattcacaaagggcaatcccttgagcaaatataccaaagatctcaccccacagagaatttacccatatggatagagtgagattttcattgctgccttgggtcacaccatcttccaaatttccttcatagtacaactaaggctattactgaacttccctgcagaatcaccaaagaaacaaaagcttatacattaggttgatacagggaaagacagatgtaaaggatcctaattccactatgattcatgacacttaggcccaaattggatttagcaacggtggttaccttcacattttagaggctgcacaacccattatagcttaaaacaaatggatccatggctagacatttgtactgtgccctgggctcaggattctcagggggttttaagtaatcacatttcacagtgagtgctgtcatgccacatagagcctgcagaggtttgataccacctttgaactatgaataagaacccattggttactttaatcatactcgaaatacttatctggagttgtgttttattatcctgtccatattactaggcgagctcaacttgattgttgacccctatctaattgtgatgctaaattcacatgtgatgtggttattgcttctagaagaagcagtaaatctttgctggaatgccaggggtcctttgtgcttccatctatgtttctctatggtagttgtaaaaacttgtgagagctgggacaggtactaatagaagaggcaacaaaaagataggttctgcacaatgaaattactcaagtaaacctccactaaaatgtctcccacgtctgacatttatttaaaaaacaaacaagtgccttgaccgatttccctttcctccttaggaaagatattcttcaaagtttcaaacaagggtgcccttgcttccctggaagaactttcttgcctgcatccctctccagttacatgtaaccattcctaactctgaggaagtttgggaaaggaaggtaagtggatggtttaggttaggtgatatcaaaatacagctagccattttctgtctatgccttttcaatattggccatcataggtcatgaagagtggtgatgacattaaaatcatgatcaataggattacactgaggcccatccagggcaacagggttacaagacgtccgttgactccttggggggctcttgggtgacttccctgaggtcctcagatgcccttgccctgtttcccataagaggaaatgtggacatctaggatgcacattggttggcaaacattccattccaacaagcacctagttctacattctactcttgggaatttctgcaaggcctgcccattgctcatgactgtcttttctggtcttttttgcagtcatatgacatgccaccttggaaagcagagaaccacagatatcaggtatgtggaaagatcatggctaaagcctccccttccatatgcccaggcccttcatgttttggtttcaattctgagccaatcggcccttttggaatttaggaataagaaaatagtatgcaatcaccaaacgaagctcgatttaggctatgttctcccatgtagatccctagtttgcaaagttttaaggaatttgttcaactcctgataatagatttctcataattttgacctacttctcatggagagaagatgacatttttagtatgttgggatctcatacttggattcttatgtggccatggtgaataggtacaggatgacaacacaagcctccagggccatttaggactcttcctttcccatgacacagaaggcccaagggacagagcctttcttagggagagagaaggattctatgatatccaacaaggctggcctccacatgaagtgttcacaaagagcaatccctttagcaaatattccaaagatttcaacccacagggaattcacccatgtggagagggtgagattttcatttttgccttggtttccaccaccttccaaattttcttcatggtatcatttggggctcttactgaacctcactgcagaatcactgaggaaacaatggcctatacattcggttgatacagggaaggccaggtgtaaaggaacttaattccactttgattcatgacaccaaggcccaaatttgatccagcagtagtggttaccttcatgtgttagaggctgggcaacccattacagcttaacacaaatggatccatggctagacatttgtcctgtgccctaggcccaggattctcgggagattttcagtaatcacatttcacagtgagtgctgtcatgcaatatagagcttacagagttctgatgccacctttgaactttgaataagaaaccattggttactttaatcacactcgaaatacctatctgtagttgtgttttattgtcctgtccatagttctttgggagctcaacttgagtgttgatccccacaaaattgtgaggctaaggtcacatgtgatgtgcctattgcttctagaggaagcagtaaagctttgttggaattccaggggtcctttgtgcttttaattaggtttctctatggtatgcatgaaaacttgtgtgtgctgggcctggttttagtagaagaggcagccacaagagagtttctgcacaatggcgttctgagtgtttaataaccatacttggaggctaatgttcagaggcagtgaatgggagaatattttttcttggccctccaaggtcattaagtcccaaaggactgtgtgttatctctagaaatgttcacacactgtataatgtcacccgtactcttgttctaggatgctatggtgaccccactaaatgaattctaaccctttgcatgatacagatgctttgcatcttttaattttgattgtggcctcttagagagattcttttctgggacgttttaagcaatactctttttacactatgcttcttcacaccttgaagcactttagaaagatttatacccaaaaacttttaaaagcagttcaggtgacccctaaagggaggactaaagggccatgagctattcatccctcttcttgacaccctagggtgcagaactaaagagctggactgaaggcttctttgtataatcagtaatcagaaaactttttttaaaaaaattaggtcagataacatcttttggggccaatttgattctttggctgttgtagtactccaaaactaaagatgactagatctgactactgctaaggataggatttgtgccctacttcagaaattatactggtgtgagatggagacaaaaatccaatggcatgcttcctcctatggatggccatttgattcctgcctactctggctcctctcctttgtcatttttatcttaattttcaaccatgccaatatttctaattacaacacaaaatatgaatcctaaaattttaaggatccaagtcattttaagcacaagtatctaaatatctatataacttataataagatactttaaatcacaaatgtatgacatcattttgttgttttcaaccacagtgaaatgtcacataatattgtgttaatattaacccacaataataataatttaacaccatgcaataataaattcatattaagaaattaatctggacagatttcatagcatgaatttggataaatttttaaggaaactgctctgacatattttcctaacttttaatatgtttaataggagtttctaaaaatgtttatttctaaatagtttgaatatataattggtgtatgagttttcttattaattaaatttgttctttgacaatttcatgcatgtataaaatacattttaataacacttatttacctcttccccctcctatcattgtcaacccaccctctttaccacaagcctctttcctgtgtttatatctttctgttttgtatgcaactttgctttgcaagggtcatttgtgtatccatagacttcagaattatccattgtagcctcataaactcatggatataaaaataatgactctccttccaccgtatacatcattaccaatagtttagcaaaaggtaggtcctcatgagtcctgcccccaaccatagatggttataatagttccagttttatacagaatgtagatagccactggtactatgagctaatagttgcagtagattcattacatctaggagaaagtagttcataggtcttatctcaatctcctggttcttacattctttttactcccctttatttatacaggatggtataattacccctttagaattgagtacttaactacctgttttgttttacctgttttgtttacttgttttcatgaccatgcatgcttggtaacaaacaaccaagaaagaaaaatatgattaaaggtcccaaattgagatgttatataacacaggacataaagcagtactcaaccttcctttctgatgctgtgaccttttaatacagttcttaatgttgtggtgacacccaaccataaaactatgtcactactacttcatacctgtaatttttctatcattatgaatcagcttgtaaatatctgatatgcagggtatctgatatgtgagctccaaagaggccatgacccacaggttaaggaccactgacataaacggttctaatacagaatgtgtgtgccaaaatatagaaatatgaatggtatacaacatatacttattattctcatgtaattgaaattttctttgtttagtattaataattacatctttatggaattttcttatgagtgactgtgtgtgtgtgcacgtatgcatgcaggggcggggcatatgtacatgacagtgacgaagaatatcaggctctcagtgtttcttaggtgctgctgaaactgttattttcttaaatctgtagtaaacacataacttaagaacataatattataatatttcacttatatttcataattactctctaagtatatattacatatgctataaatctaaggtaatttgtaggcctagtgaaacagacatcaataagcctaatgcccttggttaggatcaggaatagggaaaacatacatggcaagaaatccttcaacctttattgaaagaacttacctattttttttttataaaatagaaatactggatattgtcctgagttgcctcttgtaacacagtctattgatgtgaacatggcaataatattgtattccaatgtgaaaataattccttagtttactgagaatatatagagatgtttaccattagaaggtttgcattaggttattttggtgttcatgtctttttgttccagtcatttaagtgataaatgcagaaagtttaatcttgtagcaatatttattcctcttactttttataaatgtcaaattgtcccctccaaaactttctttcccctattatcatcctactacaatggctcagctaaaggtcattaaattgacctattcctagctttgataaactaaaaactattttgcatttttaaatatgattttgaggctgagtgtctatttcagagtctgaaagcacacctaatcttgcgcgcgcccaactggccagaaagaacgacgctgcaacaggatccttctgcacacgtttattcagtcctgtttcttcattctctatatctcccttgtttatatctcccttgtttatatcttccccttgtttatatctcccctctcgaataataattcttcctctaacccgggcctctcactcttatatactctcagccctcatccatgcacagcaggccacgccacctcaccaggcacgcagcttcagctaatcagggcagcaggggcatatctccatcaaaatggattcaccagtatcctggtacacctgtgcagctctcaagatgtttgtggcttatatgaggaagtcaggtgcaagccatatgacttagctgcagtccctggagccttcttgggattgcccccacacccgctcctcacaacctaatatgttccaagccatatacatatacatgtacatgtacatgtacatgtacatatacatatataataataactgtcttttctttactgtcacaatgaataatggcacatgaaaactatgaaacatttgttgaatcaggtaaataaataaaagctactaatgttctctttctaattatactttcacaccttttgactcaaaaaaaaaaaaaacccaaaacctattttgcaaatcctggcaatggaactgtagtaaattaacccagttatagaagagctaacttgtcaggaacaggattaccaagatcagtgataaacaaaatctcctaaagattgagaattatttcatgatactaatctacatgccctttgatagcaaaataggatttccagaattatttaaatgtgatatcctctttactaaaaatgttcctacataataatttcctacacaatagtttccttactaaatttcattatcaaaatggctccaatgggcagacattagccttaaggtttcacattaaggagaagtttgatattttaattactgtgaacagtttgatattggttacatccaagtattgcgtgaatacttggttacagaaatatatagaaataaaacatgatcaactggtaataaagatgaacgtaactatcagtaaaattgagaaagttccatgggaaaacagatacaaattatacctaaatacaactgtattagtttattataatagctatttattcttttgcaaattgatttctttaatttttgcttttgttatttctgatgaataaaatatcagcattagcatcatgtttagagagagaaatcagcatattcctttgtcattacaagttgttataggctaagatgatcataaaattagttgacacatttaaaatgagtaaaatgtgtatttatatatgatgcatatatattaaatatatgtatatattttatacatttaaaatgagtaaaatatatgtgtgtataacacatatatagtaatatattaccatatataaaataagtaaaatgtgtgtgtatatatatatatacatgtatatgtatatatatatataaaatatcacataggtagatgatagatggatagatagatagatagatagatagatagatagatagatagagaaaaagtgtgtttaagctaacacactcagaaatagatgaaaacctagaaactagggtaaagattaacggctgaactgccatttatacttgctcaaggagataaaaatcagctttctccagtgaagggacactggatatatcaacctctcaagggtaggcctcatgttcagtagtagctgaccaacatataagagactccacagtttttttgtgtacttgcatttggttacagattttatttttctttttgaggtattgtttcattttgttttctcagtttacaatggttgttgtattaattttttttgttggtttgtttggtctttttttgaaggaacttaaatttgagtgggtgggtaggaaaggggaaaggatctggaaggatatacacaaaattaaaaagaactaatcctttaagaagataaataacgctaacaaaatgaatcaatgattttaaaagatacaaatacatatatgaagaaatatgagaaaggatactatagattatatgtatattaaataatagtaagagaaatttatgaatgtgccaatgaactcagcaatttaatgaagtaaatgaatgagttgaaagattcaaatataaaaatttatttagtacatagataacagaatactgttttatcaacaaattaaatccttattgaaaacattcctacaaagaaatatagattacacagaattttaagattttatcctcatatcaccttctagaagatataaaaaaggaatagtgccaagctcaatatatataaaaaagtaacaccttcatcaaaaaatgctacatttaaaatgaagaatatacagcaatatttttaatgagtatagatatatatctttggtcaattttttataaaatagcatctaacaatatgcagaaatatttatgattaaatcaaattaaccattgaatgaaatttgttttacaatttcaaaacaaatctatatttaaaaaatcactagacagtcaaggtaataaaaacattaggaatgtatccttccataaaattactatttacatgaatattcaaaataagccaggtatagggatgtacatgcaatctcagcactgagaaagccataaagcagataaatgtttatttcaagaccagcttgtacaacaagtaagaccttatctcaggcagaagtcaaaattaatatttggaattttgtaaattaaccaaagacttaacaaaattacaaagaacatttatgcaagaaaagtgtctggctctcagtttacaaaaagcagaatttgtgttacttttaacatgtctttatttcatactcctccctgagacactgtggtagcattgtaaatcagcaaaatagaagccatgagagaagaagcaaagatttgtacccccttcccatcctaatccccccaaaataactattttgacctgctaagcagttctgtagaaaaatatatcccatgatatttttagtaatttgggctgatgcagaggcttatgtgtgagtaaacccccataccagcattaagcataactaattaatataagttattgaataccatagaagataaactagttaacagtagctgagataaaaatttttaaaattatgaaactgtaaaaacaatctgtctggtaaagagaaattttgtggtataatcaggagttctgtggaaaatgttaccacactgcttttggtattgagtccacatcaatattcagagtgcatggtagcatatgaaacatatgaagtccctagttgcttacttcttaattatcactaggccctgtgtaagtagtaagttatggctaagaaacagttgtgaactacctgaataccacatgtgaaccaaaatacacatacagaacatcccttaaaaataatgagtgacatattgtttaaagttatttaaagaaatctctatctaatcattgcatgtgcttaaaatggaaaatacaattcagtatccacatacaacaacacacattctttatgaacaaaaataatgaaaaagaacagatcaaccgttaaaacaaactctaggaatgataaaacatattttcatgcatatacattatatgtaaaaatgtccagtttcaaaatatatattgtcttagttttggctttattcccatgtaaagataccatgactaagacaactcttataagggatatttaattggggttggcttacaattctagaggctcagtccattatcatcatgccaagaagcatggcagtgtcctggtgcagaagaaagagccaagaattctccatcttgaactgaaggcacagacaggaagaatgtctcttccacactgggaggagcttgagcaccagcagccctcaaagcctgcctacacaatgatatacttcttccaacaaggtaacacctattccaccaatgctgcatcccctaattttgccacttctatgggtcaagcatattcaaaccactatatgtgtgtatgtgtatgtgtgtgcatgtgtgtgtgtgtaagtataaaaataagagattaaaacacatgtacagaaaaagatatcaatagaaactggaaacaattcagatgccctcaaccaaagaatagatacagaaaatgtggtacatttacacaaaggaataccattcggctattaaaaactaggacattatgaatttcacaggcaaattgatggaaatagaaaatatcatcctgagtgaggtaacccagacccaaaaggacatccatggtatgtactcactgataggttaatattagccaattcgttcagaatatccacgatacaactcacagatccaaagaagttaaacaagaaagaaggcccaagtatgcttgaatcccctaaaaaggtgaaacaatgcagtaagagaggttagagggaaggagaaacctggctcagagaggggagtgtgaggggagtgaaggggggggcaggatcaggcaggaggacagacaggaaagaagcccagagggccaggagagtcagtgaaagtatgcagctgccaggtgttgaggttggaggattgtctaggaagtcccagagacctgggatgagggaacttcctgggaatcaatgcagacaaccttagctgaaatgccaaaaaaaggggaataggaaagctgatgagacaacatccagtagccaaacaggactcccagtggacggatagggacactaacacacccacaaaactttagatccaaaattggtcctatctaaaagaaacgcagggaaaaagatggaacagagactgaagtaatggccaactagtgactgacccattttgagatgcatcccatgagcaggcaccaatccctcatgctattaatgatgctatgctgttcttgcagacagatctgagaggctttacccatcagctgactgagacagatgcagatacccacaaaaacggaacagaggttggagaaccctatggatgatttaggggaagaattgaaggccctcagtgaggtggtagtcccatgggaagatcaacagtgtcaactaacctggacctttgggatctcccaaagacagcacaaagctcccaaaggcagctccaatcaaaaaagcacatacaggctgatctgaggcccttggcacatatgcagcaaagggctactatgtctggcctcagtgggagagaaaatgtctaatcttgtagagacttgatgcccgagggtggggcctgaaaagggagggctgctctctcagagatgtgggggaggggaaatggaggggaaactctacaagggggggggggagtccaggagagagagcagcatttgacatataaataaataaataaataaataaataaataaataaataaaagtattcttaaggaaagaaagatgttggacctactagacaaaggcagtaagtcaacttttaaaaatatattcaaagaactaaagaaaatgaggaaatatttacataatatatgaaaatgatgcttcaagaaatatagactaaaaaacagtaagaaatgaccacatgaaaattacttatgttaaaaaagtaagtgtgtaatgtgtatgtagtttaatgggagaaggcttgaccagcatattcaaagccctggcttccatctaacactgggaaaaaaccaacagaaatatacatgatataaagaactctcaataatgaatgtcagcagaccagatattggctaacatgaatatgctctaagtaagattatctagtcaaagtacgaaacagaaaggaaaaaaaatagctaaaatatagaaaaataaactaaacaaaatagagccatagcaaactgcatttatatcaacttatacattaatgtgagtccaagaaggaaaaagagaaaggggaaatttttaagaatgatggctcaaggggctggagagatggctcagagattaggagcactgactgctctggaaagaagtcctgagttcaattcccaccaaccacatggttgctcacaaccatctgtaacgggatctgatcccctcttatcaaagataacgacagtatactcatatagattaaataaatctaaaaaaaaaaggatggctcaaaactttccatatatatataaaaccaatgtaccaaacaagaatataaataagcttcaaataagataaattcaaatgcaatcatataattctaaagaacaaagcatagtagtgaaactattgaataattaataaaaagagaatgtgaagaatgtgtaaatatcaacaacacgctcttcatcataaactatgcagacgagcaggcaatataacatatattataatattacaatataccataatgaaacaatatttaacaatttaacatctatgaaaatacactcatattctcatcaataggtataatgtccagacaaaaataacagaaaaaattcaggtttgaactgcatcatcagcccaggatgaaatgaatggataagctgctgaggtctatcagataattaaagagtcattatcgccaatatctccaaaattattctctaaaatataaagttcatcaacagtaacataagttatgagtacagtattacattgatacaaaacttaaataaaaatacagtgaagaaaaaaatctataatgcaattgttctgaggagtatggatgtaaaaattcttaataaaaatgcttaaccaaatccaaatatacatcttaaaagatcacatactaatacaaaagttgcttcattccagagataaaaggataattcaacatatataaggcagtaaatgtaacaaacatgcacacatatgaaacatagatcaaaggacagaaattgcatgatcattgtaataaatacagaaaacagccttagaataatgaataactgttcatgagaaaatactccaagtaaactatttatggataaaaagacaataccttgatataataaaggccataaacataaaattatagcaaacgtcattctcaatgggaaaagaactgacagcatcacttacaaagttgggaaataagtatatctcgtctctccacttgtcaatataatgcttaaattattcacctaggtaataaagcaatggaaatacagggtacattaagtgaaataattcaatccattcctattacagacaatatggacctacactcactgggcactaaaattctcctcagacaggaaaaccaactgatctgataaatgctcctaggaaaatagcaagatataaagtcaacacaaaaaggtatgacaacaacttttctatatttgcataatgaacattctgagcataaaactggtcacatttacaggaatgtcaaaacataaccactagaaataaatctcaccaagaaggtaaatgatctcaacaatgaaaaccttaaaacacttccaaaagaattcaaagacacgtggtttgtaaattgttattttgggtattctgagtttctgggctaatattcacttatcagtgagtgcatatcatggatgttcttttatgattgggctatctcactcagaatgatatcctccagatccatccatttgcctaagaatttcataaatgtatcgtttttaatagctgagtagtacattttctgtatccattcctctgttgagggacatttaggttctttccagcttctggctattataaataaggctatgaatatagtggagcatgtgtccttatgacacgttggagcatcttctgggcgctcagtattactgggttctcaggtcctatgtccaattttctgagaaaccaccaaactaatgaaactcaagaacaaagaacaaagtgtggatactttaatccttcttagaagggggaacaaaacacccatgaagggacttacagagacaacatgtggagcagagactgagggaatgaccatacagagtcgcacctgaggatccatcccatatacagccaccaaactcagacactattgtggatgccaacaactgcttgctgacaggagcctgatatagctgtctcctgagaggctctgccagtacctgacaaatacaaaagtggatgctcacagccatccatgggaccgagcacagggtacccaatgaaggagctagagaaaggacccaaagagttgagggggtttgcagccccataggataaacaacaatattaattaaccagtactcccagagctcccagaaactaaaccaccaaccaaagagtacacatggtgggactcatggctccagctgcatatatagcagaggatgtcctagttggacatcaatgggagaagaggcccttggtcctgtgaaggctctatgccccagtgtaggggaatgtcagggccaggaagcaagagtgggtgggttggtgtaaagggggagcaggaaggtgagggggagggtgttttggaggggaaaacaggaaaggggataacacttgaaatgtaaataaagaaaatatccaataaagtcaaagtcaaaaaaaaaaaaaagaaagaaagaaagaaaagaaaagaaacgattaaaaaaaaaaaaaaagacaccggaagacagattggtagagttaataatgtaaacatagctctgcaaattaaagtgattcacattttcaatataatccctattacaattctggaaattgttggaagaattattttaaagtttaaaaacaacactgagtacaaaaacctatgaataaccaaagcaatcctaagcacaaacagcaaagttggtattgtcacagtatgtaacttcaaacatagtatagagccattctgataaaacaacatgatacttaacacaaaacagacacatgaacaaatatactaaattatactaaataaaacaaaacatataatcccatgctgttgtgcccaactatttttttgttttttttttttttacatgagtctcaaaattatacattcaggggaaaacatctttaataaatggtgctaagacaacttaacatatatgtacaagaattaaactagggctgaagagggcttagcagttaagaacattgagggctcttccagaagtaatcggttcaattcccagaacccatgtaacaactcacaaccatctgtaactccatttcccagggttcagatacctctgcaggcttccttgggaagccaggtagccaagtgatacacagatatacatggtcacaaaacactcatacatacaataataaaaaaattaaaaaaggataaactaaattcttctctcttaccctgcataaaaatccactgaaaacagattaaaggctttatttaataaaggctttatttaatgtatgacccaaagaattgaagtggactacatagaagcacttcaagatatagaaaggcaaggactttctgaaagtaggtcagaaaatgttaggaggaatttacaaaataggattagattacattaaaagtttctgcacagcaaaagagacaaagctgtagagattgctcagctgtttcagttacttactcacataagaactaagtttggctccacatggtagcacagttacctctaactccacttccaggcaatctgttgcccccagttctctgcgcacacatggtacacatagcctcataaaggctccagacataaaaaaaaaaacaaaaacaaaaacaaaaataaataaataaacttttaagagtaaagattcagactacacatggaagaaaatctatgctgttttatttttttatatctgagaggggactaataccaagaatatgcaaaatgctataattagattatgctacctgaacacattaagcagttaggaacattgagggctcttccaaagttaatcggttcgattcccagaacaattgtggttaaacattgaaaccacaagtaatatgaattttccataaagaaaaagagatctttactgataaagctcaagtgaccaataaatacatgaataatgatcagtatttttaaccattaaggaaatgcaaatgaaaagactggaaatttatcttatgcccatcagaaaggctacctctaaggaaataaactagactccttgtggagatggctcaggtagtatagtgtttttctttcaagcatgagaacctgagtttgaccaactaaactcaagtacaaagaagccaggcaaggtggcacaagcttgtaatgccactgtggtagaggctgagacaggtaggatctctgggactcactgttcagatagcataatctactattccaggtcagtgagaaactctatcacacaataaacaaaacaaaacaaaacaaaaacaaataagcaaacaggaacaaccatcacaaaacaaaaaacaagtgaatagaaacttaggaaagacttctagcctccatttgcacacacatggaaagcaacaacagaaaacactgaagaggatgggaggaaagaaggaccactatacatagctagtgacaatatgaattagttcagccatactaatcagtctgtatacaggtttctcaaaaaaaaaaaacaaaaacaaaaaacaaaaaaaacaaaaacaaaaaccgaaaattacaactaccatatgatggagtgatgccactcttgggaatgtaattcagtatagagatatgtgaacatccttgtccagtaaggaacaaattaaaatgtagatggtatgaattagttttgatgttcatgaacagattaatagacagctgggattttcttcatccataaagagtaaaatgatcacatttatgaaaaaaattcacaaacacaaagacacacacagactacacatacacacacacacatgaatggcatggaagtagggaaaagtattcaggaaaggcaaagagggtgagttgtaagaaagaagatcaataaaagatcataatgagtgggtgatgaatgtgattaaagtagaacatatactatcatgaaaatgcaatcgagcaactggagagatggctcagtggtttaaagcactcactactcttccagaggtccttagttcaattcgcaactaccacatgatggctcacaaccatctgtaataagattccatgccttcttctgatttgtctgaagacaactacagcatatatatatatgtatatacatatatatatatacatatatatatacgtgtgtgtgtgtgtgtatatatatatatgtatatatatatatatatatatatatatatatatatacatacagagagagagagagagagagagagagagagagagaataaaataaaaggaccaggagtcagaacagatttggggatgtaaacaaacaaatgaataaattaaaggataaataaaatgacataaagcccatcactttgtactagaaatatatgctattaaaacaaaaagaaatgatagcatctagctgcatattacatttctgtagtgaataactatagatggtgtgatttcttaaagtcagccacacattacacattagttgcatccaagatgctaaacatattagaattcgtgtaatttcaacttactgagtttaaactggttagtataaaagtcaaccatttcaatgaaagttactatattttatgtaaataccttttcataattaaaatctattgacacaattatggaaataaaattaaagcacttagcacaagctagcatatacacacactttccacttacatgtgtgataaggttaaacagtgagaacatcttgtctttgatttctgtttggaatgctactggttcttactctaatttattcaacaaatgtacatttatttaaatttccatttcttgtgtgacttttatcagagcaattgatcaaggaatgggtaggttattaagttggacacagaaatgatcattattattttaataaaaaccattgaatacatttaaagttataactacatccttacaaaatttatggatcttttctaagacccaggttttattttacatatttggtttcattgattactgttaataatagtttctttttttgttttttattagataatttctttatctacatttcaaatgttattccctttcctagtttcctctccggaaatccctaacccacccctcctgctccccaacccacccactcccattcccagtcctggcattcccctatagtgggcatagaaccttcacaggacctattgcctctccttccattgatggccaacaacccttgatactttcctactgttgccttctactaaggttgtgattttggtttttcattgtaatgtatggtgttgaaaagaagaaaaaaaatgagtcttgctcatttttatttacatttggtgtgactggatgttcaaaccagtggcactgaggtgtttctggttaaacaatgttggctaggatcatctaatactaattcttattgcttttgtgttgggataagttgtggggggtctcaatgttccctgtcacctccattgatataactatgataggaaatgaaaaaatcagttctcttcttggtaccacttgcaggtgatggaagttcatctggcacaagcctggcaaggaaagtgatatactatttttaccaatacatgtattttcctattccatgctgtcctttcttataaatcataaacatggaggggaaagtgttaccgttgctttgcagacactataaatatatttaatgtcacctaaaatagaaaataacttaggacacaagtagatattattagcagaatatgacatattgtacaagtactagtcagtatagtaagtaatgaaaaaaataacagacttgcaaatttgaaaaggaggaaagacatttattcatagatgacatgtttatctataaaaaactgaaaaccaaaacaagaaccctgagattcaactagaaattggatatctaacctataatcagagcactgaataggcttgtctcttgctaattatctttgagatacatcattctaagaagctacttgtttaactaggttacctgctaaagttttatttaaacaccatcaatgaacaaagactctttattctttttatcagtgacatcacttaagtacagacaatataatacttaataaagtaccaaatgcagagctcaattttggcctgttaggttaagtttatagataaacatataatactagtagaatgattatatatgtcttctaggaaatccttacctactgtttcccaaaattaagaaaatcataccatatcacaagattagacagttgacaagaaaaacatattcttatcaagaatattgtttatgagtgcttatttacttggacaaaaggtatagtaaatggcttctcatatgaaaattgaattggctatacaatacaaacataaaaatggtacttttctttttgaataagttagactgattttcactcaacctgtctaacttgagaacatttgacttactggcaaggggttccaaacgttagacaagatggcacaactttgttatctacaacattctcagttaagaactgtaacagagagagagaggagagagagagagagagagagagagagagagagagagagagagagagagagagagagagagagagagggagagagagggagggagggagggagggagggagagagagagagggagagagagagggagggagggagggagggagggagggagggagggagggagggagggagggagggagggagggagggagaaacacatcctaaaatctcatcatttaagtaaatttacaattttgtgttatgttgtatttatagcttttcttgcttcatgaagtcttcttaagcctacaagccacagtttgactatacctgaatagtttaaacctagtgttgccttgatggctttctatcctgataacctgtgcactctaaagtagtgtataaagatctaaggctttactgaaccttagatatctcacttctcatcgtttaataattgctttctacatttacacacaccaatattgggtggatatatttataattgttataaggtaacttctgtaatccattttaaacttccactattgtctccttgcctcccctttgaatttacagttcacattttaaagaatttcaaaacaccccttatttttcattgtatttattaggatagctttggccaggtcagggacatacatctttatttatagcacttgggatttaaaagaagaagttcagataaaccatgaatacataatgaaaccatgtcacaaaaaaaggaaaacattttccttgatgatattcacactaaagattgtcactaagcctcttactttattatttaaatttgggggtgttgagaatgaaatacaaagccttacatattctacacaagcagcctacctctgaactttgcatttggttctgtttccactgtaattaacaattttttgtaggactggagagcaaacctaggatttaatgcatccaaggtaagcactctactgctgtgccaaagaccctaccaatttaacattttacataaggcaggccacttttatcacattaacttttaggggaagagggagtggtctgttaagtctcatgtttctgaaggatagctctgttaagcatagtaattcttggttggcagcactacaaccatgtaataacataaatattaattcatttatggatgactgggacatagaagctctgacatattagtcaattaagcctaattgttggattaatctgaaggcattattgaaaaatggtagacagaacaataggtcaccaggttgttgtctgtagccatgtcttagacttttcatgtctcttcctggttcttgaccactatgaggtgaacagtcttgcttcatttatcatatcttctgccatgatgtcctgcacttgtaatcaacaaaagcaatggaagcagtagatcatggactaaaaccaccaataccatgagtcataacaactgtttcctctttttaaattgttcaagtattcatcaaagtagacagcagatgcaatttttttctttcatttctaaagttttctttttttttattagatattttacatttcaaatgctatcccgaaagttccctataccctcctcccaacctgctccccgatccacccactcccacttcttggccctggcattcccctgtactggggcatataaagtttgcaataccaaggggcctctcttcccagtgatggtcaactaggccatcttctgatacatatgcagctagagacacgagctctggttagttcatattgttgttccacctatagggttgcagagcccttcagctccttgggtgctgtctctaaaaattcaggtgacaacagatgctggtgaagatgtggagaaagaagaacactcctccattactggggggattgcaagcttgtacaaccactctggaagtaagtctggcgattcctcagaaaattggacatagtactaccagaagatccagcaatacctctcctgggcatacatatatccagatgcaattctttagccctttaaaaacttctctacttcaaagcatgatgtttctattgaggtgtatgctacatatacgagagggctcttatatatggtttcttttgttttcaacatttttctggtgtgtgtgtgtgtgtgtgtgtgtgtgtgtgtgtgtgtatgtgtgtgcgcgtgcatgcgcagaggcgcacatgtatacctatgtgtgtggcacaaggcaatgactatgttctggggcaaatacatagaccaaacctggaatcccgtgaactacctgtacctgggtaactttcacctagtataggatgtttaatgccattaattcttcagcctcttaaacctttctctttgttttatcttgaacacaaactatttgaacctttgtcctattgtaacattttgtgctattgattcaagccagggaattgggtaagcaaagcaaatgagccaacaccaagttaaaaaaaaaattcctttttaatcgtgctccaccaatgccacaaacttccttcattcattctttatttttctcttctttctatatattttcagataactaataatctaggtaagagtttttatttttgaccaatgtgttatttaattgatgttttcaggtctaatatttgttgctattgttccaatcttttaaccttccagtcatgtgttatttgttttgaatcctcaatcattatgtttgaatatcagttaaatttgcagtttggtaatctgatacatatttttattacattcgcctaattgctcagatacttcacacatttccagtttttccttattaactatttgttctttccccctatattataatgattttgagcactcttttgacccttgtaataatgacttagtgtgtactaaagtagatactcattccaagttttttcagtcttcctttggaaaatgcctgttcaaagaccctggacagagtgccacaacctttgagcccatgaccaacacagcctttgaaacactagggaattctctcactccaactctacactggctagcacaatgctggactagaatcctgtggctattgatacaggcagagatttgagaagcactcaaaacctagaggtactgatgctaaaacagcactaaaatatgcccaagttccattgccaccaagccccttgtagtcatccagtagtgtgtaagagaacacagaccaattccatctggcagttgctacatattcttatgtgatatgagtaaactgttgcagctcaaatcacaggagggtcttgcttcagaggtcatactattctgatcaataaaggtttttatgtcatgcctagttggtattggggtccatagtaaaacttacatgcttatttatccaattcattcactagctatcaaactgcatacatatacagttttgcttataaattagttggtggatattttgtatgtctttacatggtgactattttcaagagtgtggcttttaaaagttggtagaaagactgctggagaaatggctcagtggttaagagtgccaaccgttctgcgctggagagatggatcagtggttaagagcactgactgcccttccagaggttctgagttcaattctcagcaaccacatggtggctcataaccatctgtaataggatccagtgccctcttctggtatgtctggagacaactacaataaatacaccttttttaaaaagcacaaaaagaatttttaaaaaaatgtggaaagcttttgtttgaatacttcagttcatttggtgatatacttgctaggcaaataatcaagtcataccgattctctttagtttactgaggaaccaccaacttcttctttccatatcagcatgattttacactcatattagtcataaacattctatatttttccatacttaccaatatatttcatctttgaagagaaaggccatttagtgggcataataaagcatctgattttggatgtaatttgcactcaactaaggaatagtaaaggagagcatcctttcaagttcatgccactaagtatatgtatgctttagcatctaaccgtttagaagtttttgcttggttcattgttggactcgactgtttttgctgcagaattaccatgtgacacagctattccatacactggatctttatcagatgcctatgatttggttgaaccaaaaacctacttgctcttttagtctttatcttatacctgaaagttaattttaaaattgaagattacaaacattttgtgaagattgaggatattcataatacttaaaccttttgttcatttttagaaaaaatggtgatctatacttactcttttttaagtgaaaatacaattttatataaatacttttgtttatttactgtttggcatacaataaaaacattaaaatcatcgagcctggagatcagtttaattttaatattatatacaacaattctagctctgatcccacataccaatacataattatactcatatattatgcacacaacttatctataattgctacaagttttcttgaatcaatgaaaaacggtgaaaccccacgtacaggcagattattacctaatgacctttcctgttatttctatttattcgaactattgtctactgacttttgtttcagcttgacatactctacctgttataattacagaaaacgttttaagtggaaacagtagattctcaaactcatatcaaaatagtgggcttggttatcagtaatttgacacaaagtgaatgtttccttcttggagttatttaagctctttgttgaggtagggttttcatgtagccttggctggccataaacatatgtattcaaaaaagtccttgaacttcaatttttttctttcagttttgttaatggttacattatattcttttggagctttgatatttacagctttgtaaatactgttatgttgccttagtcagttgactaatccccacataatattccttgtttcctctaagtactaatttttaaagtctctacccctttcccaaacctgatatatatcttgctctctgccctaattcactttgtgttacatttgcatggaagggccctttttctcaatcttttactgccaacctgtttttttgtttttgttttcctggttacttctgctcttttaatttattgctcgtatatgtaaatgatcactgacaaatgtttgctttatatagtttggtccttgtgtgtctcttttttttcttttttttctttttttaatcttttactgtttggcttgcgatttcctccaatacagccattaatactcatctcttttttgggggacggagggtaatgtcacattttggctcgttgtttgcttttgtgtgtgttcttcagtattctttgtagaaaccatagggcattatatacattcttcctaatataaaaacaattttcattgaagtactgcataagggacaaatctaaacattgtataatttaaatttaagcatttaggaaatagtaattcaagttccaacacttgttttctaataccttttctttgctttgacattctaagagtgacaaaaaaagtataccttgtaactattcaaaatgatcaatgaaaggaagaaaacagttaagttgtaggcctaggaacatacagtaattaaccataatgaacaaagtacagatgaaatagatgaataagctaagtacagtagattcagtacttaggatcactgatgttttatatccagagaaccctacagtaatcatatccttctaaataatttttcacatggcttctatatgatacgatgatgcaaaaacatttgagctataaaggacttggaatcctttcagttttaattattgattctcacatctaaacttaaatttgaactgacagattaattgcaagaggcttcatagtggactactttatttcaaagtaccacaaattacacctttataaaatgtacatataacatgacttttgttaatttctaaaattcttcagaaatactgggtttaccaaccaaactgaatactgaggttgtttaatcttaaaccataacctgagtcgaaattgttccttccacattaatcttattctaattatttatttaaagcaggatcttactaagtagccctggccggccttaaacacaagagatcctcctgtttctgcttcccagtgctgagactaaagtcatgaactaacgctatctgtattctcttaaaaaaaaaaaaaaaagacctagtagtagtgatttctcaaaacttttacttaagaattcctcttaatattgctctcattctttttagaaacttccctggatataaaacctcagtgttagtgttctcatcctatacctccacccttcactctttctgcttctgtaccctcctttcagttcctcctcttaactttggacatcgaaaaaacaagctatccaatcatttaattggagacacatggatattagttgcttctttttgttgctttcaagattctgtctctggattttggtaagtctgattagaatggatcatgataattaccttttatggtttactctagactatactggatatcatatgcatgtacatttgtgcctcaaaaaaaaattgcactttttccagctattactccttgaacgttcactcttagggaaaatttggtgcaaatacaattagaataataaaatcatttaaaatgggaattttgctttctacagctctgtaaaggttatttttctgatagctccatagcatacaattgtctcaaaactattgttctaagggtcttgtacatcctaacgaagtgctttatcaatgaactataccaatgaattaaatcaattataccaatgaattaaatcaacaacccggataaccctacaatgacttgttttagggttcagattgtggtatgttatgacaaatgcttaaaacacatttttttttttaaattgtcatttcactgttgtgtgagatgctccatgtcacttacagtagttatccatggtgtccaagtaattatgggtttattgttgtcctactaatgactcaaagaggttattttaagatttgcaacttatgcaatgtagatatgtcgtttttcttgtagtcctgttatgaaaggttctagattcttccagtaatctaggactgctcttaagtatatagagaggtctgtcacctgttttcctaattttttagttagctgcatgtttgtctcaaagcgtatttgctattaacatgctcaacttttttgagaaaacactaagatttgtttccatcctttaaaaaatcatttttgatatgcatttaatatgtatttaatatgtcttatacattgaatagttaggcctttatacaaatccaactaaaattttctttgcaatgtagagtttatattataaagttttatcactttgttattctgttcattagcaccactatatattttcccgttgtttctgcttttatttaaattgagcattgtattagttccctaaggttgctgtattactgcaaactaagtgactaaatgacatagtgcaaaacaattcattgtgttaattctggagattaggcatggtaacattcaaacaaacaaacaaaagtattatcagggctttacctaaaacctgtatgagaatcactgtctcttccaggttctgatttttttcactttttaaaagtaatctttggtattcttcatcttgtagaaacaatgcccaatctcttgctccatattactcattttcttcctatttgtgtttgctctccttatatagtaaggacatcaggcaatactaaattacagcttattctaaagccacaagtctcaattaaatacaactggatagatacttccaattaagtacctcttcacaactgtcagatatggcaatctaaaatctatatgtatagtttaccaaacttaaaacttctggtaatcttcaaaattatttgtctctgactttcttcctgttaaggagctttgatttacacatgctacagaagaaagggccaagttgttgcttcgcttgttaccattatggtagctagaagttagcctttgccaacattccctgtaaaataggaacctgaggttaattgtcataagtacctaagagaaatacctgatcaacgtccaaattatatcttcatactctgacagctgagctgagtttaaaaaattatagtaccagtgtcttaccgggttgacaaaatgtttttaggcatttgttgagttttagatatgagactctcaaatttgagtggttatatattttcataagttctatcaaagctaattataacacaatttcaaagagttacaagaagctattgactcactagaaatcctgccagcattctgctcaccttcgttaggtatccctttccaggctcacctccattcctctctataccataaaacacagaaaggacaaagctcagattgcaataagacaaatgaattgccttctccattggctttttcatttccccttctgattttctaggacaatacatttattaatagttaaaagacaaggccagtgacatggtttagcatggaagtggacttgctgctatacctcacaatgtgtatttaaccccattagtcacacaatagagaaccaactcttgcaaaatagtctacatatgaaattccattaagaatgatatttgatatactacaagtggcagaaattttcggggatacactaataaaaagtgacaggagcacactgctagttttgtagagagcttgggacagtctgagatacagaagaggaatgggggaaagagtagggttctgggtaaattacacatggcgactatcagtggatcccacaaatgcgcactcgcacgtgcgtgcacacacatagtaacaattttaatgaacaaagtataaaatgctagtcctccactagaaatgactagtattgtatacaaggatatcttcccaattttttttttttttttgccataacagacatgtaactgaaatattaccttttatgacagaaagaaaaaaaaagagggaaaggaaaggggaaaggaaaggggaaaggggaaagaggaaaggggaaagaggaaaagggaaaggggaaaggggaaagagggaaggggaaagaggaaaggaaaaagcaaaggaaaagcaaaggaaaagcaaaggaaaagcaaaggaaaaaggaaaggaaaggaaaggaaaggaaaggaaaggaaaggaaaggaaaggaaaggaaaggaaaaaggaaaggaaaggaaaaaggaaaaaggaaaaaggaaaggaaaggaaaaagaaaaggagaggaaaggagaggaaaaaggaaaggaaaggaaaaaggaaaggagaggaaaagagaggaaaggagaggaaaggaaaaaggaaaggagaggaaaggagaggaaagtaaaaaggaaaggagaggaaaggaaaaaggaaaggagaggaaaggaaaaaggaaaggagaggaaaggaaaaaggaaagtaaaaaggaaaggagaggaaaggagaggaaaggagaggaaaggagaggaaagagggaagagggaagagggaagaggaaagaggaaagaggaaagaggaaagaggaaagaaagaggaaaggaaaggaaaggaaaggaaaggaaaggaaaggaaaggaaaggaaaggaaaggaaaagaaaactgagttcataccactaagctcatcactaaagaactggaagtttaaagtgttactagataactaaagagtcagcaaactacaggtttatgtcccctacaagtgctgttatatgtgacatacatgacaatttcagattgttcccattttattatttcctcttatgagttggttatgtagaaacagaaaaagcaaaaatggtagagatgaaaagcaaaaaacaaacaaacaaacaaacaaaaaccctaaaaccttacataaataatggtttacacatgcaaactaaagaacttggaagaataagttaaaagttgcatagtactgaacagatggtttaaagttacatataaaaacatgatggatttacccactatcatctaaggaatgagaaacaagctggttttccttctgttgctttcccatacaggtgtgcccctaaaaccagtagaggatttcgttttccctccacagtaggaaagtgtaaggagtatctgaatcggtagtaaagctgcatccaggatgagtcttcatacacacgaacaatctttgtaatgattttttttcttagctttttattgggtacttttgtagaaatttgcatgtatggtctggttggctacccaggatctttatctttgcaatcatttcatctatacattctttcgacagatgtattacagcctgggaattgaggattaaaaagaaaaaagtgaaagaaaagttgaaaccactcctactctaggacattatcaatgagaaattgaggcaataactaaagcacatacacaaatatatatataaatacagatgacctatatgaactatatctattcagagaaacacagcataaagatatattggtcccaaacactgtatttggtgttcttggtgggagtaggtaaaagatgcaagagttttggaaacatcttctaaaatacagttgcataataggctaacttctactactcaaaatgtacatcatctagttagaaactagaaccctctgcacaattttatcttgatctacttccatccatagctagctatgtctgtgtcaagaaacctttttcatttgaatcaacaaataaattggaggggatagggatgtagctcaaaaaagcacttgtctagtttatatgaggacctgtgctcttctctcacaagtctcctacccaaaataaaccaacttactactaagctctttcagatccactgagaaggatcaaacaactctattgaggcagagtaatggtaaattattttaagagttaatatttcaattatttgaaatattttgatttggctaactagatttcataaggtacatgtatatctggttatttaaaagctatgataattgatgataattgagactggaatggaaggcatttagctagtcatatgggagattgtaaggagaagaatggaaatgagactctaagacagtctgctcattgtatggttccaaaaagtatcttcatattttgatgtggatccgtaagtcacagttacaaattccctaaccttgcaaagcttggtatactgagtagaacacagggtcaaacaaaccaattcctttttgtcatttctctttaacatgaattctttgtatacctctcaaaggatagtaattccatagattctgtcctttgtcgtctcttttcatttcatcacagttccctgaaagtattctaggaaaatactaacgatgactgtcatgctagagccactcattttcatcttggtgaagatcctctctagacttacccttgaataatctcactacacaaagaatgtgacttagtacactgcaactcccctgcctcatctgtcccagggaaaacccaatggcatcattatccctccatcatccatatcaaatatgtgaaatcgttcacttgactctcctctatcccatacactatcccttctcttttatcatgctgaatctttctgcaactatagcaacaatctcattaatgcaaagaatagagacacttaggctttcccagttcatatggtaataaatgtataaatttatgtctttgcctcttaagatatgcaaagtaaaatctgaagtctacaagacccatcatgatctgtctggctgcccaatcacatccagctacttatctcaacccaatacggcccctgttaaaataaaatgctcttcttttctgcctggtaaccatctaatcctttaccacgtgtcatagtttttggatctgaattctcagtctgctttgttgcatgatgcagattttatgcatgtgtagtacaggtggggtgtagaacaagtcgttcattttaaacacgatctctggatttttctagcagtgagacctcaagctttgagatttttctgttcataaacttttttttaattttacaaatactaaacagcatagagctgacagcagtgaaacattaaaatgaccaactcttaattgaagacgaaagtcttcctcctgctcaggtcctcctaccgcaactcaaaagaccctccctactcattttaacaggtactgagggaacttctgcactataggaacttattacaaagatattgtcttacttatcaagttcttaggattaatgcaagtggtagtgaggattggtgtattaataactttatttcagaatttaccttcttggcaatcccaacttgcttggctgttagtttccaatgcctcctacgctgtaagcgtctttattggatgacactcagcttccaattgtatggcttactaaggaaggaaacttctatagggcaattttcaaaacagctgatggctaatactttataataatgatatatgtatggctcatgagaagcacctacctgaactcaagactggtgttaactgcattttattctactgtcaaatggcactttagacatgtcttaccttggaatcctttcaagagtcaattacctctcccatgtcatccagaatctaaagaccacagaataactttcaaagtatattatttcaaacacacctcactggatttaagaacagttggaaagctccaggcatatttggagaccagtatcagtaataccctgataacaaccagacaaagataacaagaaaactacaggccagtatcttttatgaatacaggtgcaaatatgctaaacaaaatactagcaaaccaaatccagcagcatagaaaatggtttatgtagcatagacaagtggggtaattccaggaatgcaaggttctttcaatacaaaattccatcaatgtaatacaacatatcaatagaataaaggacaaaactacatgacaaccttattagatacagaagaagcatttgacaaaattcaaaacccttttcttgatttaaaaaaagactcagtaaggtaggaatagatggaatatttctcaacttgcaacatctatgaaaatcccacagctaacatcatatttaatggtgaaagacctaatgcttttccactacaatcagaaacaagaaaaagatgtacactcttgccacttcaatttaatatcatattggacgtgctagccagggcacttaggcagggaaatcaaataaaaagaatccagattggagaggaaacaaaagtatttatattcagagatgcacaatcttgtataaaaaattaaaaacagaatcagctcagaatagctacagtatataaggttaatacataaaaatgaattctttctagatgtagcaatgagtaatccaaacaaatattaaaaaaaaagttgtttgtaaaaggatcaagtgaaaaacatttaactcaaaaaagccaagatgtatacactgaaatctataaaatagcattgaaagaaattacacacctaaataaatggaaagacactccatatttatggattataaaatttaatactgttaaaataccaacatacgtcaatctgatgtatcgattcaacacaagaacaatcaaaatcacaggtgctttttatgtagaaattaacaaatagattctaaaatccatgtggaatgcaagggacccagaacaggtaaaattatcttgatgtagaacaaagctagagaactaacacatcctaaattcaaaacttactctagggctacagtaattaagacagtatggtactggcataggaagagacacacataggacaatgggacaaagttcaagaatccaaaattagccatatttatggtcatttgtacgtgtttttgacaaagatagcaagcctactcataaggaaattactaatagtctttgtaacaattaggtattgttctactagatatccacatattagagaatgaaactggatccctaaaatgtaccacatgcaaaaatgaatcaaagacctaaatttaagaaccaaaaccataagatacttaaaagacagtaggagaaatgaaaacatgtacacaaagtgttcatagttgtattcataatatgcaaaaagcagaaagaacacatgtatgcacaaccaagtggacaagcaaaaaaatacagcatatcaatacaatgacaatattcagccacaaaagaaacagtaccagtacatgctacaacattgatgcagtttgaactcattgctttgtggaaggtggcgaaacagacaaaaaggccacataattgtatgactccattaacatgaaatgaccaaaataggcaaattcataggcatacgaagacgagtagttgccaggggttggagttaagaacaggcagtcactcttaatgggtacagaaaactttttacagcgatgaaatgctctggaattttataaagacaatttcacaactctgtgaatatactataaccacaaattttacactttttaaaatggcgaatttttatactatgtgaattatatctaaaagatgtgagaaaacacatctcttccatttaaaggtggacgatataaggtcaggttttagaaaataagtcttcattacagacatttctaatctctctctctctttttttaagttaacaagcaacgttgggagaactgttctcaggatgtcttccaagatgttatctaccagctgcatggtaatttcactgaaaccacacaaccagagataaggtaggagtgggtataatccaagtcaagggaatggcagtgccaaactaaaattcagagtcatttgactgaaggctacaaccccaaccagtgtgtactatattccagatacattccttatcattttctatgtgtttctgggtaatgaaaaatcataataatgatccaaggttccatgcatgtcagcataataatcttaatttgttgtttaatttagtcatgtttgtttttgcaaaaaggaagatgacaaattttaggtggtcatgtggacgcaaccttaccatttgtcatcccttttcctgcctgtatgacttttagtaaggtgtataacctctcaagttacagatatttattggctttgtgaaaatgaaggaccatgtgcacagatctttagcagtcattgaaaattcttgtcagaatttacaggaatttgagcagcaaagtataagaaaatgttaaatatgactcacatatatttacagagaacagcatctggaggattcctctatgaaaatttgagagactagtcagtaataacagaacgaattaaggtatcagttgccatgactgctggaagagtatgagtggcataaagacggtggtcaagagtacaccagaagacaggatgtagagttacaaaactgtcttgctttcaaccatctagtcttttccaacttactgtcttttttaccctggggcagatataatacagtgattccagaaactctattcaataaatgtatgtgtatatttcttgattaatgcttatctgcctactgcctaagagacagaaagatcagtacaaggtagtttccactgtgaatttactcagattccatacaaaagagaagatgctttaaaaaaaataataataatagtgggacaatatcaaagctaaaacacaggaaagaaggaagggaacgcacttctgaaggcctcctcaactgttcaaataaatatgatccaccaggctgtgaccagggatatgtaggctgctattacactatgaaggcacactgtaactaatagaagtctttatgagtatgatactttcaaaattccaactgaaagaatatgtgagttgtataaagttaatctaaaaaggaattttgagtagtgatgaaagggatgctgaacaggatgcactagtaaattatgcagaaatccacctgtacaaactattcaaaggggaagtactcatacaaatcagaaaaaaaaatgctttttgagaatgaaaagaattagaagtagttcagagtcaggaagataacctgagtaaatcaaaggattggggcctgaaataaagtacaattaaataggtctgagagacaataactgacaacatgcatatatatgcacataaactgtgagagggtaggaaacagcaaaagctatggtaaacatggaaaggccaggaaacaactttgtggagttgctctttccttccatgtttatgtggagtctaggcagagtcttcaggtcaagttttatatagtgagcacctttacccactaagccatctccccaggccaaaaaattgacagttctaaaggaagtaacaagaaataactaggagatacaagagtaagaattttgtttttatcggtactgttttgtactatataatgacttagaggtaccaggatgatgtcctggaaacacgggtctgatatgatatgagatatgagacccacaaaatatgaggcaagagaaaaaactttgggttgaacaggaagttcagaggagtacttctaagtacaatcaggagagtatccatacaaggtgtctatgagttgggatggaaaagtgagcctttcaggaagctgtagcccaactctgcaaggctctcaagggttaaaaacaagacttctttactgtggcaaatggagactactagtattattgcaagtacattttcagtgaaatattcctggattagcagcctttacatagtgaaatgcagtacatacatgcactcaaatattcttacaactgttaccaaagtcaattttcttatttgaaagtagaagaggggaaaaaaaaagggcctctgtctatattgtgtaaacatttttcctaccaaacaccaggaactgttttacactctaaagatgaaagaagcagcaaatggaagttactattattattattattattattattttattctgggaagggtagaaaggattaaaatagaccctgggataagcagttaaagaatgaacatcttaaagagtagcctcagtaaaacacttctttctctagggtatgtggattcttgagaaaaaaattctttaaaagaggttgatttcagcaatagccaccttatggaaacacggagtaatgctgcctagttgatgcatttgccacatgttaatgtgaacaagttctctgaaggctcatttataggtttcttttgatatatacattcctacacaggatgtatttccaaataaaggtaaggttattgcaaatgaatttgatcacacaattaactatagaccacgatatgtacactcaatttgtttgctgcagctgccaagtttccagagaagttttgctgcaggctgtgcttttatgccataagtttgaaatgttctacactactaaaaggtattttttaactcgtaagtattgttccatgacaatctagtaaagcaatcatgaaaaggcagccatattaatgtggtaacatgccgagaaaaactgattaggaagcaagtgagagtttttttttttacctctgaaaactttttaggatttttttttcactttcttttaaatatattgatgttacttctgtttgataatctatattatcatttgaaaactttcacacagatatagtatcacaactacttcaatactgtagtgacaataaactgaagaacacaaatctcttcatgaatttattttataaaatatacccacttaatttgtcttcttatcactttcataatacataagaagcacagtggacaagatgcccattaagatgactatagtcacatttagggggtcctataatcaaggtagcatacataccacaacagtgttctaaaggctagctcagaaaaaaaaaaaagaaaacaaaacaaaacaaaaaaacctcacgttaccttatcacaatatggaacgcactgtgttctcttttcccattaaaatatttaagccactgtttcatttagcattacagtaaataagagctctgtctcaactactacaagaaagaaaataatcctaagacatccttttccccttccaatgatttgaaagctaccattatcccctgccaattaaaatcatcaggttgatttgcactagttgttaaaacaatcaaggcacaagctcaacaggttatctgtagcttgtagtaaaatgatataccagtatgtctctccttagttaaaaatacataattcttttattttgttatgcaacaaaagaaattaacatcacagacatagaagactagggatgggaaactacattaaatatccagtaatttaagcctatttgtactttaatataggacatgaaatctttaacacctttgaagtaaattttaatttgggggatatacaatttatttctcaggagtactagttccattcatttccaggcctgctaactgtgtaaataagtaacacaaggcacagtagctgtactttctgttatgctgcaacactgatcgagtgccttgaaaaatggttgattaaacaagatgacggcaacagaaggggagactttggattgtctattaaaatctcagcaataataaagattcattttaagtgcacttttacatgcttatttatacaacaaacttcctaattttgttgcaataggcttgactatcctatcatttggccagatgcactttccccagtaaacttaaacaacaaaaacaacaacaacaacaaaaacaacaacaacaacaacaacaacaaaaacaaaaaaaaaatccctgtcctttcatatactaagaggattggctactgaaacagttcattgcaagacacatgaagacaacatactgtggcatgagttgttttaatttgttgtgctgttactaaagttctgagggctgtggttcaaacattccaagttctcccttccatctttattggttctcaaaattttgtacagaaaactctttgggggctagaacagcagtacttgcaccacactgtttccttgacttcaagtttcaaaagcaaattgttagaaaaaagttcctgatttgacttagatacagggacaaaaaatagcacatacttgaagattacatgttctacaaatggtggcaatgttttccttgcgagaatagtttcgttggtatatatatcttaaatactcaaaaaggctcaacctcaagcagtaataaacacaagcaaaagtgatttaacccttaaaataaatattcagaaaacctctctgtacatacaagtgaaagaatatgtaacactttcacgcaaaaaaataattataataataataaaggatttgttcatatatgcagctgaaatctgctgttccagcccacaatgtccccaatgaagaagggaggcacagacatagatgactactgtggttcactatcttacagcctttttgtactgggatactattaccatcaaattatccctcttatatttattttttaactttttctttttctttttctttttctttttgtttacagcatgccaaatcctttggcatatgtgatggccttcaacaatctctctttaagtttttctttgcttgaatattccggaagtaaaaggacattaaagcaagtatgagatgtaggtaacctaaataaagagaaagggaaaaacaggacaatcatgagtcattggaaatatgctcagtgttaaatgctcctattagatacatatcttgttaggacggtttttaatgagaaactacagattaaatatatcataaacattgtactgtttagttaaaaagatcagttgggtctttatcctatgaaataatgcaaaaattaaagtgatgctgatgatagtaacatttattatctattgagtttccactctgttacctattgctttagatactttaacactgaagttcatttaaatctttacacaacaaacatcttactaaacccattaaaagctgaagtcactaaacaacttacaccaaagattaaaaattattcaaacctggcttttaaagattttgaagtctatgctctgtatatagatttgaaatactgctggcaaaatgaaaatgataatgattgattataaattaattaaaattagagccaagatgtataaaatgtctaattaacagtaataaaaatatatctgtcgatgtatatcgaagtctacctaggacatattgttcagccccaccataaaattgtgaagtatttattggagaaagaatacaatcaaaagtcagaatgatttaaccctagaataagaatctagtataatgtaaaagaacagacaatcctctaaattttagtgtagccattcaaagtagactgttctataataaggctttcttaataaactatgaaacaaagggggaataaaacataacaacttgataacgtctgtacttctgtaagctccataattactttttaactacactaatttttaaaaaaattcctcaaatcatgaagggaaaatatccattccactagtgtttgctgacttagatatttcaatataacatcagaagagtatatagaggctacatgttggctctgcttgcgtgtatggaatatggtgaaaaggtttacagtgggtacaaagttggagtttgatattacctttctgtgtctgggccatttttggctataatcatcttcaattttcctagtcctccaacaggtgctctgtctgtgcctgttgtaaactgcagaaagagtcttttctgttcatctgtaaacgaatgaacaatttcccagaactccctaatgtgaaaagagaatactggttttaatttgacatccactataaacaagatcatagtactacaacattaaggccaatgtcacagtgaatattaaaagtaccatttacacttagtatgtaagttttagtcagccagattttatatcttgtaggaactatatatgggataaatattaataactcttttgctcagtaattctacttaaaaagtacttttgtattcctaatgctaagcgtgatgttttaaaatttacttttgtaaaaaatacatgttcaatatcctattcacatttctaaaacctcaatctaaaaatctatcaagatcttctccaaagcaagagaaatgtgcaataaatatatctgtaatctatgctgagaataaaattggaaaatcaagtaataaatccccaaagtaaaagtagagagaaataatacacaagataagcacagttaaggatcagaataggacaaaaaaattgtagacactggaagagcggaagaaagaagtgacgaaactttccaaagatgatagaaatacctggtgaagggattttaatttttaaaaaattgtaagtgaaaagtagaaggcattgaatcacataaagcagaaccaaatattaaagaaacagcagtaaaaggttttccttcattgagaaaccacttaaagtgactgtactatgctttgctaccccatgacatttactaagagcaggtccatgggaggaaatatataaaaaagtaaatgataaaaaataaatttaagtccaataggaatattatgaagagttcttcaaatgagaaataaggctttttggaatatgaaactatttttaaaaaagactgagtcgtgaataatataaactctaacatgaaaagtttaacgatggcatcatgaatcaaaaataaagagattaatgaattcaaacagaaataataacacttgaaaatactgaggcaggttggtgagatggctcagcaggtaggagcacagactgctcttctgaaggtcctgagttcaaagtcccagcaacctcatggtggctcacaaccatccgtaatgagatgatccctcttctggcgagtctgaagacagctacagtgtacttatgtattataataaataaatcttttgggccagagtaagcagagtgaccggagcgagcagaggtcctaaaacttcaattcccaacaaccatgcgaaggctcacaaccatctgttcagctacagtgtacccatatacataaaataaataaataattcttaaaaagaaaaaagaaaattctgaggcaaatgcacatcaactctagaaataaaagatgattcaaaaatgaggtaagtaaatgagggaagtgtagtaatttgtatttgacaaacatccaacatttctacttgacaacagtctagaaacaaaaagcaagcaaagggttaggaagtcagaaggggaaaggagttaaaacaaaatattcaaaactgaagaaatgcatatcaaagtaaaatggaaacaaattgttaattgactaaaacctttcacttggtaaaaaaccctaacaagtaaagataaatgacattaatgtagagaaaatactgtaaattactccagagacaaatgtctctcatgtacaagaaaaggcaaagggaaaggaaatctaaaaagtattcctatgattcagcattttgaaggttgaggcaaaaggtaggcaagttctaggctaggctatgctacaagcaagctattgttcaaaagaagggtgtgagggggatcaataactgaacaataaaatgagtaagagacaatattaaaaatatgattaggtaatataatgaccttgaaaatagaaaactatacttcaatattatgtgacagctggaagagagcaaaaaagttgcaaagtaacctctatgttaataagggattattttgataatatacttaaaagattctttctaggtttgttccttgacaaggccttaccagtcataacattaaatagtaagtcttattcctggatgcagttttctaataatttcttttaacaatgttttcttacagggtaggggataatgttcaagataaggcaaaatttcaaattttaacaaagtcatgtgtcatgttaaagatacaccaacaccaagcaaagtcctaagcaaggctaaagtcctaatggtaaaacacatttactacattaaaagtaaattcatgagttcataatatctgaaaacaaaaaaattaccatattatctcttcagtatcaatcttaaatatatttgactttgtcttttcaatagattgatatcttaaggtaacaatataatagttgatatgaaaaagataggaaaataggagaatgacatatgtcagatgactagataaaattatttccttaaatcaccatttttataatcacaggtgaaatcatcaattaaggaaagacaaaaaagatatacaaggcaaaggactattgatcacagcaattttgttactgctccacaatctctgtaaacagagcaaatttagataggaaaatgagaggtcaacaattatgttttgtttattttagtcttctgaaaaggagacagaattatttctctttttaaaaaaatgaggagggagttagaggaacataaatcagcaagcagtgctgcaatggatcctgctccaagtttccttaatgatggatggattatgaactggatgggtataaaaatgtacaaagccgggctggagagatggctcagcgattaagagcactgactacacttccaaaggtcctgagttcaaatcccacaaatcacacaaccatgagccaccatgtaaaggaatgtgatgccctcttctgatgtgtctgaagagaacataaaaatgtacaaagcctcaaatgacatagagaaagtatgaatatttcacaaaagaaatgtttctcctcataataagcaagagactcttctaagaacaaaaagattcagtcttgaaggtgactaaaatggagaaagaaaatcagaaaaaaactcaaaagaaccgaggaggaatgaccatgtagaaatgagcagaatgtgcttttacaaaaaaaaaaaaaaaaaaaaaagaaagaaagaaaagaaaattggacctgagcaaattaagaatataatacacgagccaggcgtggtggtgcacgcctttaatcccagcacttgggaggcagatgcaggcagatttctgagttcgaggccagcctggtctacccagcacagccagggatacacagagaaaccctgtcttgaaaagcaacaaacaaacaaacaaacaaaagaatataatacacggactgaagaaccattgcaacaaggacaggaatattgactcaaggttaagaagaaacatgacatttaaagcaatgtgtacttttaaagaagctagggaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacattggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcgttatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcacctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgacaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactgtctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaccagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatctagccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtactgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccaaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtaaagcattggaaatgtaaatgagctaaatacctaataaaaaatggaaaaaaaaaaaaaataaagaagctaggacaaaaactaagacaaaaaatagtaaaaaagaaagaaaatgaaaacctttgaattgaacagagaatatgaagaattaatcacattaaataatggtgattttattcacactgataattaaaaaaattttttgaaagaaaaaaaaaacaacagttcgttgaaaaagaaatgcaaaaaagaacagcaaaaaggacagctaatagaccttgaaacaaaaacaaaaaacaaacaaaacaaaaacaaaaaaaaaagcggaaaactttcatatagcaatggttccagagcatgccaggaaaagaaaaattaggctccatttactgataaaagtgaacatgaaaacctatttgaatgaatagttaaaaaggggatatggcacaaagaactgaagaacaagagttatttccaataaacttaacttgaactaaaaaagaactgaagtagcactacaaaagatgaggagaaagaagggcagtagcattatgaattactaccctatgaaagatgaagagcaaaccaaaccaggagctaagtagttcaacaagccattataaaaatatccaccaactattcaagtgccccacttagatttaaagtaacaggagatttgaagcccgaaattacaaggtgattggtgggagaaataatgcggggaggagaatttggaggagattgaaagaagcttattggaatttaccagaaaatggaggaaggtgtgtgtgtgtaaaccaaacaaaaacaaatgttacctagttggttaatagctcaatttttactatagaaagtaagaactaattgatccctgatcttttaatctattaacatgttttctcccaggcatggaacaaatcatttttctcttttgtagcacacagcagcaggtcttctttcctttctccctgttacttaaagtttcttagtatagacatctattctgtaaagtggcaaaaaaaaagggggggggggaccagaggtaacacttctttttttgctttgttttgttctgttttcttatgttggcttatttcctctttatagaagaggaactaaagaacattcttctacaaatgaaaatgataatcactatgttgcgtagaagttttgtttgtcaaggatgcaaaatttatttctcttgtcaaaacctaaaatagactgtggattttccacgtttatagcaattgaaatatatatattttgaatgaataattacttgagcttttacatcaaaaattattctaacataaaatacaatgtatttggaactgttccctttgaatggccgatttttaatagtagtactatgtaattttgattgttatagtttcaaagtctttctgaagaagatatagtgatgaagtggtctatcattcttttcatgggaaagaagcatggataagaacaacaacaaaacaaaaaaagccaaggaaagattttatttttaaaaacacgtataatatataatacttacaaatatatgatatgaccctgatggatacattataaaaaaaactgtatctgtactgcatgtagaagccaagattttcaacataataaggcctcaagatctaagagaattagacataggcaaaactgacacaacttttcatttaaaattttagaagtagggctggaacttattcggtggctaaaagcaccagctactattgcagaggatccaggctggattcacaacccctatatgatggctcaattccagtgtcagggaatccaactccatcctctagcctcagtgaacactgcatacacacattgcatagactcaagtatgcaggccactcatacaaaaaaaaaataaaatcaaatcaaaaaccaaagaattgttatttttaaaagtatttaattacctattttctattgttgagttgtttcgtattttaattaactgaaagaattttattttacagtataaacatatagtaatgttattttaaaaaataagaaacaaaaataggaatcaaaataaaacacacaattttattaaatagtataatcatgaaaactttgtcaatatcaacaaaagatgaaaactataaagacaagaaaattagaaatacatagtaaaaactaaaattctaaaataaaggctatgaaaacaataactagatcagaaatgaagtttagaaaaccttaacagagaggaaccttgaaaaaatgtgacagaaataaggttcaattagaaataaattttaaaaattataacaaatacaaagaaactagagataaattcaaaactatacacaactaggaatatagacaattttacaatcttttacaaacctaaaatagaaagattaaaactatgaagattcaaaaagcaattaagttgcaccatggttcaaatatacagtattaatgggctatgggcaaagttctgctaggaatagttgttgccctgaagtgctctcctatcctttgagtcttagagaccctaggtaagacaaagataaccacataggctgaggtactgttagaagtaccagcaaaaagaagctggcaagaagctacatgaagtatatattcgccaacatgcaaatagctgaggaatagttttcctctactcaaagacaggaaggagggagggagggagggagggagggagggagggggagagagagagagagagagagagagagagagagagagagagagagagagagtgagtctcactggagaaacatgccattcttatgtgtggggcccatatccaacagttagttgaccaacacaatggcatctgcagaggttcttggtctcataatgttaattcatggtgtttctcccccccatatcttaaaggtcctctgattatgtattagagcttctagttttgtgagttttgcattttttatgagattctctagtacacaaatatgtgtgtctctacatctatagaatcatctagaaatttttctctttggttctttttcttgcttggctgttgcgttatcctaatttgtttgttgtttgtttatctttattattccttgatgcttgtttgcttccttataagagtcagaaaaggcagggagcagatgggaggggaggtgtaggcaatctggaaggggtaggaggacagggaaaacaataaatatattatatggaaaaacaatccatttttaagaaagccctcaaaaaataaaacggaaactatcatgccaagaacaaagaaattaaaacaactcatgccaacagaaattaaaaaattgtttgaattttactgacaaggcttttaaagcaatgaaagtaattataagcttattctcagaaatgaacaatgaaataatgcataagaaacatattatttaaacttattcactaaagcatacattatttcaacacaaaaattacaaatcaatgctggatgaaactatggtataactaaatggaaagtgctatgccatgcttgagatttagaaaatccaaagtgatgaaaatgacaattctcaaattgatttatccaatcaattcaacccaaatcaaaacatcaaaaataaatgttattcatgtaaaattcagcaaacagattttaatatttacatggaagtaaaattagtgaaaacattaagaacaatgaaaaagtaaagggattctcaccatctgatataaagacttgctctttgttctatcaaggtaaaggagtcatcaagatgtgattttgatcaaagaacaaatgaataagcagagaagaaccaagtctagaagtaactcacacaaaactcaatttcaacaaaaataaaattcagtgggggaaagaaagctgcagactagaataacacatgtataacatgtttgcatatgatcctttaaaaagaatacattccaaaagaaatagttcataatcagtggaaagaagagtggggaagataattcacaaagtaatggttaaaaggatggaccatctagtgattgccatatctggggatccaccccataatcagcttccaaacgctgacaccactgcatacactagcaagattttgctgaaaggacccagatgtagctgtctcttgtgagactatgctggggcttagcaaacacagaagtggatgctcacagtcagctattggatggatcacagggctcccaatggaggagctagagaaagtacccaaggagctaaagggatctgcaaccctataggtggaacaacattatgaactaaccagtaccccggagttcttgtctctagctgcatatgtatcaaaagatggcctagtcggccatcactgcaaagagaggcccattggacacgcaaactgtatatgccccagtacaggggaacgccagggccaaaaaaatgagaatgggtgggtagggaagttgagggggggagggtatgggggacttttgggatagcattggaaatgtaattgaagaaaatatgtaataaaaatattttaaaaaaagataaatacctaaaagacagctcatgatcctgagtcatcagtgataagcaaatttatactaaggtaaaattttatttcacactccaagacaacatgaccaaagattaaaagagatacagaatacgttctagcactgcttgtcatcttaggtaaaatggcagtatcattttacaaaagcattcttgcagtgcttcttaaggttaaaaatgttatttacttcacaaccacaatcctccaaagtgcttcttcaggagaaatgaaaacacttcaacactaagaatgaaaactttatttgtaacagccccactgtcatgataattctattgccaataacaaaaggataataatcaaaatgcatacattaatcataatcaatctaaaacattattttgccatattgtagagataatactaggatattcccattaaggcttctgtattaccatgtttatccctgttatgaattacctttaaaactgagcagcaatataatggttgccacttttgtgactggtgttagaagcaaatatgaatgataaatttttatattcattaataattgccattgtgcttagaaatgatatatcatatgacatgttatggtttttgttttgctttactctgaattttgttatttaattacctaaaagctgaataaataacatatttgcttttctattaaaaaaaaaagggcaaagcaagagtaatcttctacaaacttaaatgaataaagtaatactgtaatataaatataacaatgataatgtatcattactagacacagttaatattcattctattgttaacatatttgagtcttatagctcaagtgatctacaaaaagataactgtttaaatacctatgacatcatagtggatgccaaaaagactactctgcattttgatcagtcacattagaagatggggggaaagatctttcagaattggatagtagcatattacagaagtagaaataagggcatttgactagagaacgatgttagtggtaatactgtcctaagaattgttcagaatcactagtatacatggttcttcccaagtatcttaaagactaaataatgtgccatcttacacatgaccaaaaataaggcaaagggttgagaaaatatgagacttaaatcatttaattcatgaaataaagcattagactgcatgaaaattggaaatattaatacaggtctatttttgagcttacttgtttggtaaccagtacctacagatacaggacacaaaagcacacatctacatgtttgatgaataaaatcttcctttttaagaattaaacaccttacctaatcacaacagattccctcgtatagccaccgtcatactctgtagtttcttctagtgcctggaaatctagattctgaaaattatagggggaaaaaaaagcaccttaacatccatagtacaccaaaacaaaaaacaaaacaaaacacccaaaacaaaaaaaaaaacaaacaaaaacaaacaaacaaaaaaaagaccttttttgtatatgtctttcttacccggcttccacatataagcaattcaatttcttctggtctgaataagtattttaagggcgattcattagtcaccatatgaaaacctctgcgaaatgccttgaattgtttttctacagatttattgagaatgtagtctgaatagagattgacaaattcctgtaggaatattaacaagaaagcatattctatacaaatgaaacacaattagcttttggactagttttaatacccaccctccaccccaagaaaaccttcagcagtattttttttgttactatgtttaaaaattagatttcagagagttggttcagtgcttaaaaaagcattagcaactcttgaagaataaacataagtcttaaaaaattaatcacatgttatatgtacaaagaaaattattttcacaatttctcacttctgacagatataaaagttgtattcatatgcatagttatacattatgattctatgagtaaatcaaagagaaattatataaaatgtaattaatagtaataataatgaaataatgtaaacagtaagattaaaataaaagatttaaaaagactgtatatatatataacaacagaacctctagtatgcaatataaatttgttatgaatactgaacttgagaaaaccagaatgtctcaggtttcctctggaaattatggtactggtaagttagctactgtatccagctcagcaaaaatgttatttgttggtaaactaagctattataacaaattataaaattttatagtttttataactacttcaaaccatactaggtaattctttgaaaactttacaaattataaaatttgttatagtacaaatgtagtttgtatcatgacagtacaatatttcaccaaaaataatagtataaattaatatatcttaaaattatactatgtaatattttcttttgaagctaagttatttcctattgccaagtaaatagcttttaaagttagtaaaaaccaaatctaatgtgaataatctgatatgcataattagatctcatgacagtacaatatttcaccaaaaataagtataaattaatatatttcttaaaattatactatgtaatattttctttttaagctaagttatttcctattgccaagtaaatagcttttaaagttagtaaaaaccaaatctaatgtgaataatctgatatgcataattagatctcaaatggaaaatgtatatacacactaaaccagatgtcaatcactgggctctgtatacctcttaggtttaatatggtaaggccctgtttctagcgttacattatagtaatatttacccattcaatcttttgtagtctgtttagtctttctctaaaggggaattaacaattctgtacaatcacataagctcttatctaagaggaaagtgtagctttactatttagataaatttgtttatgtaaagtttttataactgcttcaaaccatactaggtaattctttgaaaactttactgctttgaaattatatatttataaaacaatgacaaaaatttaattaccttcctgttttcatttgtaattggaattttatcaccattttcttttagatcatacatcattgggttaccaaaaagatctgtctgtgatatctggaaagtgatcatcatatcatcttccacactcccttcatattccaataaatcctttaaactctgatataaaacctaacaaccagaaagagaagtgaggttgccaaataaatactaaaagaaataaaaataatagattgttcattctttgtagaaacaacttgtcaacaaaaatgaagccataaatattccacatctctcaagtagtttaataagatagaaaggttgtcacaggcaatgggtcaatcttaaaaattcttcaaatgatcagttcagcaacagatttcataccatggtctagaatatacactttctctccatgattgtggcagggtacaggaaatgaggaaaaacaaacaaacaaacaaacaaacaaacaggaaaacaaacaacaaaaaagccacacacatatcaactgtacctatcaacaactttactacatagactcatatgggacattgaaaacatgatgttttcaacattttttatggggtcaatcaaaacatacttgataggatatataaaaaatgatgtttattatacttaaccagattaaaagtattttactttactaaacagcagtatcaacaaaagtttacaaataaataatgttcctatataaactgagataaacttctgtatttagatacaatcttaaagactattaacgaaggacaacttactgggtgagagtctcccaagtcacgaaaggttccttttttccccattagcttcctgtatacaaccatgggaaaatggacatccagtatacaattattgtaaatagccagacccaggactatgccaatcagagtaaactgaccctcagtttcaaaagaagatggattaaaccaaaataatttcgtagcttcatcatatgtgaacatacctataaagaaataattaaaagtcattttatccacttaatgactgaaaattacatatgaaacaaatgcatgattaagtaaaaaaaaaaaaaacaattggagaaagttgattaactttaagttacttaaaattcatatcaaatctaagctaatataattttaaaaaatattttgtgatctttcagcttcacatgatcttcattattcaaagccaaagtccagagattttttttcctatcatcattattttatctaggtgaacattaagagatagtcttttttttctttttttacggaacatcaaacaataaaataaaacaaaactaattgtatatgcctttcaatttttctaagtttattttcagttgcttctcaggaaatactttttatacaaagtctaacaagctgggggagagagtgggctgtataccttagcacttggtaaaatgagtaaggaaaattatgagcttaaggttagagtactaatacaatataaaaagattgtctaaaaaagccaaaatcaaaatgagcaaatcaaaaagttttgggaaatgtttttctaatggaacaagagtattaaaaaacaaataataaagcattaaaatgtactttcaggttaattttaatatttaaaatgtttccttattttcactttcagttttaattaaaaagaaaagtacacttttctccttgaactgtagtaatataaattaagtctaagctttttcttgcaatttaatatttgtggaatactggtttcacaagtattcaattcatacttgcattccagcttgaaaaatgtgagttatgtatgtctgtatcatttgcatgccaggttatacatccaggtaatatcaaaagttccagttcacaaataataaatctgatagaatgtcaccaatggatgctcttggtctcaaggacaattaagctataaattaaccagaggataaattatataacctatgattctcatgacttcaggttttcaaatctaccactctaaggtttttcaaattaaatttccctagaaggcaactgtgttctactagaatatttgactaagtaatatatggaagaacctaaattaagtgagtgatagaacagctcctgaagcagggatatggcatactcaatttttttactgcttaccataactgaaaatatttataaaccaagtttatactttaaaagactaacacaccatcataatcatatcactaatacttaccaatatctggattaaaaatttcctccacaaccaactgaaaaaactctttggaaacgcctccctcatctactccttgttctccttcaaattccacatacaactgcttcttcaagtctgcaggattttccatagcaatcatctctagctgttgattgaaaatataaaaaagaggacagttgagaagaggaaaaatgtaagatataagtagaagaaaataagaagcagcaataacaaaacaatatggaaagaaaacaatgaattttgtttctgaaaagaaaaaaagcaaactgacttacagtttttggcaagatttatttcaacacacaagagtatgtactgtgtttaagaagctatgcatttcttagtaaaggatatagccaaaatgctgttgggggtggggtggggggaatagttgcaattatgtcctgtatatcttcatctttaggggtctaagggcctatgaatttattctgtaaagaatctctatattggtctactttaactaatttgtatgtcttcatgtatgtatattcacatgtctccttccacctaagatgtatttcctcaggatctgtccaccttgtttgtcaggaaaggatctctccttgacctggaagactgcataacacaataggttggactgtcaatggcccctggcatctctgccagtacctgcctacctagcatcaggactacaatgcccacttcaagtttcttttctttaatagagttctgaagattaaactcagttcttcttgcaagttgatctaccttctcagctcgcatacccaattttcaggtcagtattcattgaaatttattttcagcagtactttgttggtgaacatataagaaactgttctttcacaagttccacatatcaccactaaatattaacatttaattactaagcttcaataaatcaatcctattttctaatgtattacagaaacagaggtaatattcttcctactctaatggtatatgcttaatatatcatttctaaggagcaaaactgttaacatattacccttcaaaactatagacttttaaaattcataaatttatgtccccaagaaattaataggtaggtctgacactttacagccaaatatatagatttgaatttaaccttagaaatggagaacaaaattataccaacaacagcattagctagaaacctgttctaagacagaataactttgtacacttaaatttccatgatcatcttagctcaaatttggtcccaacacaatatactattattactgtggtttctcccagttctcaacttgctaagaaaacatgttaattattgattcaaaggcttgttggtttcaagacagcatacatctgtccagtctctacccttttcccccaattctggttctagtatgttctattatgatcactaaaaataattttctatatttttgctttcgtttgaaatgtaaaataagcataatgagatagtatcaaataaataagtgaagtgtgtaaattaatgctctaccattaactctaagtttgaagttgcaagtattgtcattctagtaatttttaaatattccatgttttctatatatgatagaacaagcatttcatcccagcactcaaactcggtaagtttagtgcagttatgtctacacagaaaatctgagtccagtgagagctttatagtgattctctatctaaaatatgataacaagtaaataagtatttccagttttgctagaatatttaaccacatgattttaaaaacagaagtattcccggaataagagcagcagcagcaacaaattatgaaacttacagctcactttacaattaaaattgttctgatatctacaactccttagcaagtaggctgctaaaaccattttacagaaagtcccttgaagtaataaaaggataaataacttaagaaatagtaattcagaagagaagttttaatccagggagcaagcttatagcccacagtttacctacttttccaaagaaaatagagataatatttgcttttagattttgtgtgacttctttggatatcaatattttcaactatattcacatattattttcagaatcaggatatatttgtatataatttaaaaatagttggcagcttaattctgtaagtgaaaatgtccaactagcaatttaagaagaccattctcaatgttgccaaagtgactttgtaaattcttattttgtttgagatgatgcatcagtagcctgtctttttaaaaactatggtaacaaaacaaaacataaaatttaatactaaccatacacaaaagccattagcaaagaaagtcacattatttttttttccttaaatatagtaactcttgctgagaggtggtagcacaagcctttaaactcagcactcaagaggcagaggcaggtggatctctgagatctagaccagactagtcaacagagcgagcaagttccaggacagccagggctacataaaccctctcaaaatacaacccgcccaaaaatgtaactcttagaagagacacacacacacccttaaaccattgtttcatcaactaaagaatagtataaaaaaaaaaattaaagttatattttaaaaatgaatttgtaaaatcaagctgtcttacatgtaattggatacatgaaaactattgggatatacttaaaattctgaaaaaaatataagacaaaataggtagtattggcttcatagatagcgctggagaaaaaatacactggtattactatgctgtattaatgtacaatagtaactatcacttcctaactgtacttctcttcatactaggaaatctcactctcatcaactgttaaaatattattcttaatttatttggcaatacaaaatcctagagagatcattttttacaagctgaccttataggagagcattccaagaaatctaagcagaatgatatactgatttaaaaaaaaaaaaaaacattctataaccatatcttcaaggatcaaaaaaaaatttagcgccatcatttaaaacctttagacagggctggagggatgatgtatcagcagttaagagcactgactgctctttcaagtcctaagttcaattccaagcaaacacttggtggctcaaagctatctgtaataggatctgatgctcccttctgatgtgtctgaaaataaataaacatgaaaggaaggaaacaaggaaagaaggcgggcaggcaggcaggcaggcaggcaggcaggcaggctaaataaaacctttagacatccagagttaccatctaaaatcctatgttaacataactgaaaacaaaaaactactaatgatactatttaagttgaacaacactcaaattagctctatttaaaaatgtttagactctccaagaagagtaatttatacactttgataaaaatctaaatatgactttcatttctataagtaaaaatctctctaaatttctttcttttaaattattatatgatgctaagctcttatcgtactgactacttcatctcccattctggttgtaagaaattattttgaagataaagggaagaggattccattaatttcttttttttttctttctttctttcttcttcttcttttttttttttttttttttttttttttttttttttacacgagacagggtttctctgtgtagcccaggctatcctgaaactcactctgtagctggcctcgaactcagaaatctgcctgcctctgcctcccgagtgctgggattaaaggcttgcgccaccacgcccggcttccattaatttctattagaataattttaaataagagaaatcacattaagtacaattctattaatgaatgaattacacctagagcagcacagaaaaactccattattaaagcaatgtatgtcaaatgatttttttaaatcaagttcttgttgcaataggtatttatactaagagaaatgatggaagctcagctagacaatgcatctagactttcagagaaattgaggaagtaattcaaacaactttttcttcatcgatgtgtgccagctcctgggtttttggacttttctttccaattctacaacttagcaattatttttggttaactatggaaaattctagaacttaactaaatttattcatgtcccataccactgtcaactcctattttagtcacactgacttcattattcgttttaaacactggcaatattctacacatggatattattcaataatttatacttataaactgtactaactgttgtttcccaaatattgatttgtagcatagatgtaccaaaacatgtaaagaacagaccactacattttcatatcagaattctttttttttttttttcctatcagaattcttagtctgaactcctaaaagtccagaccttaaattctgttgctgtgtttttattttctgggcaattctgcttttagattgtgaacgcagtctaaagcatctcgcacatggcaatactgtctctggatacatctgatcttattccactttttaaaaaaaggttttaagattttatatatgctatatccttgaaatcactttattttttaaaaagaggagaaaaatgtgccatttatttgctggtggtagaagaaaacatgtgccaaggagttaattacgtcttgtggattaaactcagtcatcaagcctggtggcaagtgactttacccaataaaccaacacaacagcctacaaagaatatctgttttttgtttttttttttttgttttatttgtttttttttttttttaagactgttaaaacttctacactaggattgttgttcaaatggaagctgggatctcattagtatttatatctgtataattttctcgttaaaaaaaaaaggccaaaaccattcaaaataaagcaaaagaaatattggagttttttcctttttagtagaatttgtagatttatttctttattatttatttattgcttagtacatacaaattttaaaaaatagtaccttatacttttatactgactattctcttgtgagacagatcttctaaaaataacagttgggggaaagagttgttatactgattgaaaataatgaataaacttttgcttacaaaaaagaattggctaggagtgttatacacacataattttagcactcaagtggaaaagataaacaagatcagaagtccaaggataggctaaacattctttattaaataaaaataaaaagtgatttccaggacagccagggctacacagagaaaccctgtctcgaaaaacaaaaaacaaaaacaaacaaacaaacaaaattaattctaatttactcgcctactgtctaccattaagccagctaatctaattaacactgaaatgtgagattcaatagaaaacttacaaaagtcacatatgtaatcttttctaggcctcacttataaactaaggagaaaacggtattatttccttcatagctcaaggttagggttctataacctttctttctttctctctctctctctctctctctctctctctctctctttctttctttctttctttctttctttctttatatttattaatgttgagttcactgcaaaacttctcattccttctctatacaaccttactatgcagttcaaaatgaccgggtcataaaagattgtgattaacatgaatattctgccaagtttttttatgaaagaaagaacaaggtttcaaaacaatagggatttgtggagaataaagacgtggaaagagagtagaattccatcagttcatatgtgggtattcttttgaatacagcttgctgtaaacctccacctttttgctattaatctaatatgaatataataattatcctttgctcagggtcatcaatttgatctctaaagtctgagtctttgcttctatttctaaccctttcccactagtatgctgaaaaaccaagaaattttagaggggttcagttgaaaatgatccagaaagagaaaaaaagaggagaagtggaaaagaaagcaatataggacaaagaagagctgggtgaaactcttaggaattttctcaaaaagtacctatctttgtaattctactgcttatcaatgagacaaacacacagaattgatgaaggccagggcttctataaaatactactagtcgaatatggatattatcaaatgaatcatgtcaaaccatatgactagttcacataaataagatttactagcaacagtttgttagcataattacaagactcaactgttaattttactccaactacagaaggggctaatttcgtcctaaatgaaattttacaaatactatccaagttttaactggttcttaactcaataactttattatagaaaaaaatagtataagaagataataaaaaaaaaatcaggtaggacaggtgcataaattttttattaaatgtgtatttagctcagtcttaaggcttttcagatttcgacaatccattcccccccaaaaaaaataaatgttcaaataaatattatttgttagttatctgttaatgagttaatattatttgttagactataaggatgatgcttcaatctgtaactagtactaaatcttacatcaagtttatacaagaactagcactaacaggaacaattaataccaagggataccctgaattacttatatataattttgttaatatgtgactgacaattttcaaaccaaatttctggtttaactgacagggactctgtaatttttgtcgtctgtagaaaaaaggaagacaagaggcaatgttatttgaaaacaaaaacaaaaatcacgcagtaagaagttcctgacttcccagttaaatcatctagatttacctggtattactaacattaattccaagctcccaaaatagccactttacagaattttcaagattcatgttattattatttaaaaaaacaaaatcctacaatgtcacacaagacagagtggcttagaactccaaagtcttattgataatacagactaacctttcctggtcatatcatcaagttcacaatagaaagctgagttgtgttacacataatggaatttgaagagcagctcttattcttttacaatgtacatttattgcattatttcttccaattccatcttccattcttaaaaatgtgtataacaataccatttgtcatgtgttccaatctttgaaaaccaatcttttcttcttaatggaaatatatgaggctggctttcaagattcagaaaatccattccttttacttgctttgtgcctgtctgtctgcgcatctgtgtgcatatgtatgcatgcatgcatgcatgcatgtgtgcatgtaaatgccaaaaggggaaaacgtatgtgtggaggtcaaagaacatcaagtatcagactttgctttctaccaactgagacagggtctagttatttgtcagtttatatatcagattagcttctgaggatttttctgtctatactttctatcttgctttaggcagtactattacaaatggaactaccatatcctgttttacatgtattcagaaaatccaaggataagtcctcatgtttgcacaacaaacgttttaaccactgagtcattcccctagtactagaaaaatctattcttcttcaaaagagaattatcattagacaaccaggataccagtatttttggtaagaagcaacaaaggtgtagcaatacagatcagaaatgttaacataatcctatttttttccaaaattatagataaaatgaataaattgaaatacatcactgtctaggttttagtttaattccaattttaaataatagtcaaacttacccggaccagtgcatcatctataatatggtcacgtctgactttgagtctcaaatacggattcaactgctgtccttgaactaggctgtaaagaacagtgattcttctttcactgtacatgcgaattctattgtcataatataatcccagattctttgtgacagcattcaatataaagggacatgtcataaaagagaatttgttctctgtttcaactttgaaaaaggtataatctttgtccatttctagaacatcattcagtggttcattaatgaattcttcaaaggagataagtggttttcgacagtctagagttttaacgccaagttcggtttctagtggatccactcgaggacctttcttatttcttctttcatctcccagaagctcctgaagtgttaattcgctggactcaggtatgggttcttcatcatcttcctcattatgatttgtgtccacatcccctcccactacatttgcatagtaaaccattttcaaacactttgaagcagcaacaatggcatcatcatcattcactagatttcggctattaaattcattgcttatgactttgtaggtaataagttgctgaaatgtttccatcattctccgaatctggtcagcactgtatttagaccacagcctaatcagttttccttgagcttcaaggggtagcttacacatagctttgcaaaataatggcaacgccatttccagatattcaggactgtggagattactattctccattacaataatgaacaaattgagataattaggatctcgagtatacacattatgatatgtcaaatcacattccacgttaggtgacagatatacaagtgcattcaggaaggcagtttctaatttttcattagcgagcaaactgctgtagacccttctaatagcatcaatatccacagtcacatcatcaggacctaatttttgtacattgttgtctccctgtgaactatcacccatccttgaagaagatgcttctgagtcttcttccatagcagcagcagaacatgcagctttttccttttcatcttcatccttgtcttcatccttttcttgaagagatttcaattcctcctttgtgtgctgtttgactttccgaaagctcagaaccagtgcctcagcactagaaaatattcttccaattacacgaattaaaggggaataatcctcactctctctacaaaattcataaatttcatatactttctcttcagttaggtaaatcacatctagaaaatggaaagaaaaagaacatttatgttgtaatatacatgtttattttgttaaaataattgctagtgaaaaagtaaaatatctaaacattctggacttgatttagaatttttaaatgatgtaatttacttattaacaagtaatcccaacaatctcaccctttcttggcattcattgaacaaaatataattattaattatgcattgataattaagacatgccttgtaaccaagacatgtactggtatgtaacattaattgtaggtatgaacaaatatatatacttgtcatttcctcattgtactttattacaaccttaacaaaaagctactatataaaatcctgaaatcattttcctttgcattgttctcaaaaaactaaggaggtaaggttttataacaaggtttccttagccccttcatttgcaatcaactctttctatacttttgtatatactaaaaccaaactgactcatcttatgtattcctaatttcttccagaatttccattcagaggctgaggaaaagatattactactcatgtaaactctactgaagttaaaactgctactacaactactactacctatgaccattactcaggttctaacaattcttaacagagcaactggaaattattacagtcatcagtcatttaaaaacaaacagaagaaagaagctaagaaagcaaaaaccacaagcactaaaacctatatttattttctcccagaaatagaattgggatcataaaagtctctagcttctcaccactaggccaaatgtaaatttcaacaaaggctttaccatttcaggttaacaaaacaaaagatacttatctttttggaaaaaggtaacattttacatattaaagttttagaaagtaatatatttatcaaataataatgttgaaaccactaatctctttcaccaaagagtaacatattataattattaaacatttaagttaggataattttatggttacattgataatacacctcatacattgccaatatatctaacatgtaaaatctttattatgattgctacatattattaaaggtacctaattcaaaaataagaaacaatataaaattcaagtcctcattgatggaatggcttccaaaacataaaccacaaagcactaaactatatatactacaaacctgtctatggcccattctagagtattgatactttttaattttatgatcttcaattctttcttttaaaaaaatgttctatttacttattagaggtgatgagggtattgagctgagttgataacctaaaagaattaattttctccttctacagtgtgagtttcagtagttacatgtccctatctgaggcagcatggcaagccaagttcaattcttagtctactaagaataagtaaaaaagaaaacactaacatggagctcatttctcgttattctaactgaaaaaaatacatggaatcttctttaaccattcaagtctaccaaatttctctaaactgtaaccaaaacacagaaaatatcagtaatgaataaataggcagactgttagaatataatgttttatctccctatcattgaattataaaattagttagaaagtgcaaattctacatacagaacaatatacatcctgcctgaaagagaataaagctctagatccacacacctttgatttgcaatgtcttcctttcagagcacagtcattaaatcactctgacattctagtaatacaaactactattcattgatatttgttccacgtagtactctacttaaaatgtttaaaatgtttatctccatctcccccacccctctcatgtgtgcatataaatcactgcaatcagaaataaaaagttctaatctgggtatcaacaaacagttaagtaaagaaactttttttttttaagattcacctgtacattctaatatatgtgtgcttgaaaactgtttgagacatggtttcacatagtagaaacagaactggaaatcagctcaaaatctttaaaacataacattttatactccaaacagtttcacgcaaaaacagagttgtgatacactagctgataactacacctctaactaaagtgaacaaatataattatcaaactgagggaaacatgattaagcatatataattcaaaaatattaaagaagtaaaggcaataaaatttggagtgatccacaaaaacaaagaacctgtaaaaaaggaacacccatgggctaaaacaaggcaactatatccattatatactagatttttcccacagttagttgcattcaactatgatgggatactatttttcatttactgttactctgtcatgtccactctgttgtagaaacatgtataattgagccaatgcaattttcacattcaaaatattgattagcattcacctacttatctacaatgtaaacaaattcatgaaataggactggctatatatttttgagtagcaaagctgaaagtttttttttctgatttttctttagtcctattgtgaaagtaatatcatgaagttgtactataattttatttcactaattcatttaaacatgtttcaagtgatagtggaactaatccctggcaatctgaaacattcaattacttccattaagagaaaaaaatagattgaacaaaatcaatcatgaggcaaagtaggaaatttgaagaattttcaaaatatagaactatttttaaaatactagatgcattggggacatagcttaatcgtgagtgcttatttttcactcatgaggctatcctcagtaccaggtatcagagtataaaactttaatttcattactggggaaatagaagtgtgagtattaaaagtacaagaatagtgccacttaacttgcacaaaacaaaatgaaacgaaaccccacaagagctgagtaaagactattactggtaagttacgtccctaagcagtatgaaaatatctaattcctgacgtagagagggcagaatgtaagaaggaaaaaatgtaattttcagataactattgcaaaattttaccctgctttcttaaaaaaagaaaagaaaaaaaaaaaaagactactttacactttatatttgtatttctccttttaccacagtccctggagttctagagccgatactaggtattcacggcaaatgcaatgtacatagtagatttttgtgacctaataaggtattagctacaatataaatcattacaaactgagttcaactcatcatcatattaatttttagagtataacttgcttctgactgacaactaatgaatcagtaaaatataagaataaaatgtaaacaaactaaataccagtcctttaccacagtttaccagaaaaggtgacttttactatattatagtgcgataacttaaggtgataaaaaaagcaaaaacaaaaataaaaacaaaataacaacaacaaacaaaaaaacaaaatcaaaacaaataaacaaccccctccacatttaaatctgatatagctttcaattaaccattttgaattgaaatataatctcttacctttaaaatcttttccttccttcttgttcatttttatctctgagttgttagatgcaccttttgagttctcaaggtaagctgagcttgctcctttcttggagggatgaggatcacagagttttgcattaattttataaagctcaagggctttaatagctgctgcattgttatccatacgaagaaaagttggacaggaagcacaaaactcattcgtgcaggcctcatttccacagccctcagttaactgatggtagtagcgttctattagatgctttgcagctgctcgcttcctgtaccagacattcaaacaataagcacatttattagtatagctcagaaacaaagcccaacagataaggcaaaagttagctaagcaataaagcaataaactaaatatttagatgtagaaactggaaattcactactacctcccaaagtgttagtaaaataataaacattttctaaaaaaactgtgataaactatgtcagcttataagataattttaatatggcaggcttttctttggtttaaaaaaagataagcttaagttgatggtataggacccttaactatttagcagaaaacaacaaaaacaaacttcactgctacatctccatggcagtttcccttttcactaatataaaatcactaattcattttaacagtttcaaatacttgatttccagttaatatcaaacttctagagattaaaattttttactcagtaagtaatcatgagatatttaaaagtgctttataaataaactatctaatttcatattataccgagagagaagcaccaaggcatacaaccttgagcccatacttgtcactatcttcattaaatccttgtcataggaaagataaaggtttaaacttccatcaggggaaactcatattcatcttacttcatcaactttaaacattaaaattaacatttgattaacatatttttcatgcaaagtaaccaatacaattaaaggaatgaattattttaccaaacaagaagttgttctacataacctaaattctataatttgactctaaaattctattcttggagattaccacaaaatttaagttgaaatgtatatctggcccataataatgtcattctaaggaatccgtttggttctatacaagcatgggaactgcaagtagaaagaatctatctaatttcattctaaaacttcatgtcattattttagatagaactaagtgactaatggcactagagataaacaaatatggcactgataagtgactttaggactatgtcattctttgtatgacaaagaatggtatgtcatacgatcctaactcattcagatacttatatttagaaatattccctgtatatttaccatgcatagtgtacaaaggccaagcctgatgactcaagtttgatccctgtatccaacttggtgaaaggagagaactaattaccacaagttgtcctctgaactctaaacacaccaaaacatatgcccagtcacatgtatctacagaaaataaataaatgtgatgaagtttaaaatgtatcacgaagttagagataccacttatgagaaaaattcatcaaaaggaagacttatttccctattatttatggaaactcagcatgcttaacaacagcaaaccgcttcaatatactgacagcatgcaccaaataaaataattaccaactactttaattttgttacttccttaacaaaagctagtgatcaagttataaatgtaggatgaatgtttcgaaatattaactatttttctaaataattgactgagttaattcttcctagctacgttttttctgtaagtatgtacctaaacactaaaaatttctaagtatcagtacggaagttttaaaacttcatctacgtgatttaaatagagccaatgtttatgtttatatccaggatttttaagcgttaatttcaaagttcaaaacactagttttctaagagtactaggccgcccccccaacccatacacacacacacacacatacacacactacttctttatgtgataaagaactctcaatactgaagggagaaatgagaccatccaaaagtcagctcaatgtaattagttgaatgaactaattttctaggcctcattttaccaccttatgtccttataatttgtctagctagcactctctacatgccaaataataaactcagtacattgtcaggtactctgattatcatatgaaacttgaacttgaagattatcttctgtctacagctagtaaaagagaaagacctgaaaagatcaaatcttataattgatcttatgctatgtccattaaagaagtcaggacaattttcagcttcagaattcaatttatttccaatcactgttttacagattataatttcagaagaattaattcttaataccagcagtcctaaaaagttttaagggggaaaaaaagacctaagtaatatataattagaaaacaaaatcttccaaaaaattccaatctaaacttaacaaccatgtgtactatctgggtacagtatagaaactcctgaataaattatatcactatacttaagatatcggtaatttattgaaaatggatatgctaagcactttataagaagactcagtctgtaacaggtagaaattcacaattttgaggccagattgtttgggttcatgaacagtttctgtatctgagttaactacttatttagtctctttctgtgtctcagcttcctcatccttaggatgccagtatatttcagaattcaaatgatttaagaattacaagtgtttagactatttcagtaaattttggaagaggtaggaaaaaaataggaggtgaagatgagcaaaatgcattgtatcatatatgaaatcctcaattaatggaatagtatgtattacctgctacatgctaggccctaatggtaagtatcagatgctattgcaattgctataatttctatcatttgcatgagtatatgacttggtcaagagaactccattgcactaaatctgaaaaattaaaatctaggcttaattccaaaatttgaaattttagcattactaaaggggagacagcagagaaaatgtttgaaactgaccagcttttttgcaccaagttacaagtagtagcccactaatactaataattatattaaattaaataaacagaggtcataatcaaccatattaagttgactaatttgattaatgtgcgtttattaatattaagttaattaaattggttaatatgattgaatatgattaattaacaataataagctattcttttctcattataaatgataccattgaatgccaaatgcagggcatataaattcattaaggacatgtaaaaggcctctaaagttggaaacatacatactaataatagcttttgataaccttccaatgctaatccatacataggactggtcactaaatcatacctcatgtgtcaaatctactttttttacagttgaagtttagaatattttatagtcttaaatcattaaaaaattatattttgtttcatgtgtgaaaattgcataaaacttaaatgtctatgtccataatttctaatgtaacatggtaaatttcaagtacttgtatatttcctgtatgttctctatcataatgtatctagccaaaagtaaaatgctttgtcaccttaaaatgaattccctgtgcatgccagtgaaactttcaaccaatcatctggcctccttactttctctctttgtcctcagaagatgaatagagtaaggttctttcttcctacttagtactttaacaaaaagggagtggggaagtaggaaggaacataaaagaaaaaccaaagtaaagttcaggaaatgaagtgaatccgtttcctgatattcataaccaaaactctacaaaaaggaggtagcagttacttttgcctattcatattccactgacttcgtggaaatcaaagtacaatatagtgagtccttaaataaaaatatgccttttttatttagtttataagaatcaagtgaatcctaccagtaaaagtgttcctctttaaataatagtttccacttctttattactttctaagaagccattaaaacggattctacggaaactgatagaagcagatgcagggacccacagccaaacccttgaagagtcctgctgaagaggggaagggagccaaaggacaccacaaaaacatagcccacagaatcaactcagcagggctcataaggggttaacagagactgaagcaacaattggggagtctgacctgggtcttctgcatatgttatagttttgtatagcttgatgtccttgtgtgacaattagcagtgaaagtaagggatgtctccgactctcctgcctgcttttgagaactttatcctcccaatggcttgccttgtccaccctcaatgggaaggttatgtgtgtgcctaatcttattgaaacttgttgttatgccaggtttggttgatattcatgggaagcctgctctttaatgacgggaaagaagagggtagtggatctgaagcatgagggaagggaggaggaaagaactgagaggagtgcagggagaagaaaatgcagacaggataaactatatgaaagaattaattaataactaattgatgttttccacaaatgacaataaagagaaataattttcagtgttctcagtagcactaataacattatttgctgggtcctaagttaatttcgggatagttgaatacttaggaatagtaagtaaatcataataaaaatgataaagttataagatattcataactatatatagatagcatcaaggagattatacactagaagaataaagaattcccacatagttcagcatgagaatcaaaaacagtgaaatagctgccatgaaaacaagaaacagaaacatgaaagagataactaacaatatgacttattcaaagtatcttttttaaaaaaataagcagaataaaaacaaagattggacaaaagaggtaagaaacatatacagcccaagactcaattaacccatgcataatctagtaagcactgcttagtgtctttcataggtaaatgtctcattattttgtaaggggttttataaaggatgtacctttataaaaatcactactcctccaagaaatggtggcttatgcttataatagtagcatatactagactaaggcaggaagatcttgagtttattatgaactttatgtggaggaatcagtaaaccaaatttcacaacttgccccaagttatttttaatgtagaaacttgtcaagagtaaaaaatgtgatctcacaaacaccagagatattcataatacagttaaaaccagtataaggtagggtctattgaagtgtcatcaaatcatgtattacaagactgaaagtacaaatatgacccaattagtatcaggaaccatttgaaagtcaattatatataaaataaggaaaatttcttaaagacagatagatgggtggatggatggatactaaaaatgcttttattcatctttacaacaaagtactagttgtaaaaatagaactgtggaattaaattttcacatagaattatttatcttttaaaatgaataaaccactgtttttggggttttttttttgtttgtttgtttgtttttcacctgcccagtttcatggttagaagaaagtaagtaaacatttacaaatttagaaattgactagtggagctggaaacatagtgtagtagaggcacaccaccaatatatattgtataaatatataaaactttcaaagaatattattttttaaacaaagatcttttcctaaaaccataggttgactcttctttctgtaaacagaaggtgaatattggctgattgtagtgaatgctagttttagaacttgtatatttcctaagtaagaattttgaaaatggaaatctgtcctgtattagtttggaaagagttagtaccactgccatacaaacagcagatacctgataggagactagagtgatggctcactagtcaaaagcactagctgctttttcagaggaacagagttcagttcctagcatgatgtcaggtggctcacaaaactgcctgttcctccagcttaagagcattaaatgccacaggcacccacacacatatagcatgcatatgcatatatgcatatatatatatatataaatatatatatatatatatatatatacacacacatatacatatacacatattaaatctaaatacagtcaaaaccaatgcacaaaacacatttgaaaaagaacacatgtccttgctaaaatcccattacttaaaagaaatcttgtgaagccaaaaggctttcagacagactcatttgagaacatgaataaccactcccagtgatagagatatctcagtagttaagagcactgattcctcctcttccaaggaatccagatttgattctccacaccaacaaactggtgcagtcagctgtgacacctggaggagttacacactcatctggtctccatgggcaccgaccatgctacatgtggtgcacagagatatatcccagcaaaccacagataaacataaaaaggaggaggaagaggaagaagaaatggaggaggagaaatatttactcttaccacctctaatggatgaagtacaatatctaggcatagctatcagataagaaaaagataaaagatacaggaacatttggaataagatgcaagactacaaggtgctaatgtgataaagtgaatgaaaacttccagagtatcaaaggataaattcaaattctaagagagatgaagaatattggaaatcacaaaagagatactacaactgagaaacagagaaaaatactatgtagcaaaaaggaaaagcagcaagtggctccagccaagtggtggtgataagggatatctcatccataaggtaaaacagatgggactgactaaaacaatgcaatagtcttgatcacagaacaagcaagagtactcacaaagaattaattggaggtttcgtcatgacactgacttattctaagtcagcactggaaagggaaaaatccagtttataactgtattctggagaactagtcaggtgtcatgaaaagggatctacatttgtttgaaaacaaacaatcttgggggttgaaaaacatgaaacaattacaaataaggaaaaggggtgaagtcttgccatagtctatgggtgggaagaaagctgagtcaggtagatatggagtagagacttgattgactgagaaactcaagcaaagtagacaaggcttgaagggcactgtgtcaattaaccagcccttctgtggcaaggatcaaaccctacaatgtggaggataaagtgtcaagcctacaaaattggctctgtctgtcatgagggttgctgcctacagtacttgacaactctgaaggtaaggtccagtggagaaattgattccagctgtctgataccccttgcaatgtggtgacgacaggcaggatctaaaagtatagagaccagttctctagaacaaacagtgcttttttgacttccctcatttaaagcatacttgggagacaccctgtggcttgaaagtagccaactaagacagaaaagctggaaagtccctgaaggaaataatgaatgagtgaatgaatgaatacataaataaataggtgaaaatttaaaaaataaatgtaaaaatccctaggtcctgtacagcaaagttcagctagcaaagacactggtattcaaaaacactgacaatctcaaaccgaagatagttttctatgacatctgagctttgactggttccaaatcagcaccagcctcaataacaggactggaatattaggggatgcagaataaattactccaatacacttccttttacttgttattgttttagactttattttttgtaagactattatttacttactattctatttatttgtttgctttctattttgtttgctttctttacttattgaccatttgttccattcccattattcttagtattctacttcttttcatttaaacttgcttcccttttcttttcctgcccctttccccttttttttttccttaagctgctatttctaatttgaccctaaacaagttttgactacttacattattctaaacatatttttaattatcaatggtgctataaatgctggcatcaatcaattcaaagtctatatctgaaaattgtttggttttattgtatgtgttggaggtttctttcctcctttgagtagtgttaaggattgaaaactcaacagaaggctaattacaaataaaactggaaaacatatccatactgacaagtgtacaaattagaacacaaaaacaaacaaaacattataaatggaacaaagttatttcagaagatcagcatttaataaccaataaaaagatggccaactgtttgaaatgctgttcaaagaattctgaagtacatgtcaatgagaagtttagcaaagaaattgagactggtgctgggagggaggatgatggaaataaataaaataattaaaaatctcagtggaaaccataaataatagaccaaatcaagtacaagacagaacagcaggaattgaagaaaaatctgtattcagacacacaacaacacaataagtaaacacaaccaaaccttttagaacatgatcaaaatgaaactaaagaatacatggagcagaaggaacttaaaagcactgagactaagtcaatgaaataacagcagaaattttctaaaatatcgagaaagaaatgaacatctatacagaaagatgtgtaaaacccaaataaatcatggacagaaagaattgctcctgagcacagtgtagctcaaatcctaacactacaaagaaaataaaagtatcaacatactaacaaaggtaaattcactgtaacatccaacctctcactagaaatttttaaagacaaaaatcttttcaatgattactatatccaaagttatcttttaaatgtaatataaaaactttccaaggtaggcataacataaggccacttgtgaccactaaactacagtatacacttaaaggaaacttacacatagcagaatgatacaaacagaggagctcaaggaaaatgaattttgtaattctatatatgaaaaattaagaaagaagcaactgtgtctacataagttaatgaaagaaaaacagaacaatgaaagaaacaacaaaatataaatgtttttagcgttccatttatgagacagattagccaaatgaattaaaagcaggatcaaattatttgttgtctataagaaatgtatttcacttgaacagaagctaaaggaaaaaaaaaaggagactgaaaagtgagtggaaatcaaaaaagaactggactactgacataagtatatgactgtatactataaaagaaaacaactgggctggagagatagctcagcggttaaaagcacctactgctcttccaaaggtcccgagttcaaattccagcaaccacagggtggctcacaaccatctgtaatgagatctgacactctcttctggtgtgtctgatgacagctacagtgtacttacatataataataaataaatctctttaaaaatatattaaaaatgtaattgaggaaaatacctaaaaaaatattttaaaaaatatttaaaaaaagaaaacaaccaatgagggatgtacaattaattataagtatatatgcattaaatgatggtgtacccaagttcataaaaacaagcactaccagactactgtaaaatccaacctctcgggctggtgagatggctcagtgggtaagagcacccgactgctcttccgaaggtcccgagttcaaatcccagcaaccacatggtggctcacaaccatctgtaacaagatctgacgccctcttctggtctgtctgaagacagctgcagtgtacttacatataataaataaataaatcttaaaaaaaaatccaacctctcaccagaaagtacaatatccatatagaaagtaacaagtcaaaatacagtaaaatacagtaataatcttaactttccaaattaataacttatctgatggaaagaaggaaggaaggaaggaaggaaggaaggaaggaaggaagattgattttatctaaactgtaccaaacatcaaatggacttatttcaagacatctaaaaaacatctcaccttctgcagaataaaccttggcagcccatggaactctctaagagataaaccacatttttgaacattaggcaagtcaacaatagtaaaaattactttcttgtacttaacaaataataagagaataaaattaaaatgcaaaaaaaaaactaggtatgctacaaatacctgaagacaatataatacaatcttaagtatcataagagtaactgaaggaatcagaacagaagtgttttaaaggaataagtcaaatgaaaagaaaacacactaggaaacagcaaaatcatcctcagtgaagtaactcagactcagacagataaatatggtatgtattcacttataaaaaaaaaggatattagcagttaagtaaataataaccaaggtacaatctatagagccagagaggttaggtaaagaggggggatccagtagggatacaaggatctccctagaagagtgaaatagattatacagccaactgggagtagatagggagagtaagcaggtgtggggaggtgagcaggtggagggagagatggggttgagggaaagtgtggtagaaacagctggaattggggaggaaagaatttccatgttggtgtagaaacctagtgcattggaaatgtccttgaatgtatgaaagtgaccctaataaaatggtctagtaatggaagatatagaatcttaagtggccatctcttgtctccagacaaccaaagtgagttgcacttcagttaagtgaagagggtcccatagaaattcccaaacagggctggaaagatggctcagcagttaagaccactgactgctcttccagaggtcctaagctcaatccccagcaaccatatggtggctcacaaccatctgtaataggatccaatgccctcttctggtgtgtctgaagacagcaacagtgtacccacttatatgaaataaataaatcttagaagaaggaggaggaggaggaggaagagggagaaaagagaagaggaggaggaggaggaggaggaggaggaggaggaggaggaggaggaggaggaggaggagaagaagaagaagaagaagaagaagaagaagaagaagaagaagaagaagaagaagaagaagaagaagaagacgacaagaaagaaagaaagaaagaaagaaagaaagaaagaaagaaagaaagaaagaaagaaagaaagaaagaataatccccaaacagcctaagctgttgtcaaaacaacaggttgctacctgaaaactaacagtagagccctactgctaaggacaatatccacactacccaatgaacacggagaagccaagctgctgcctgcatggactcttcacccctacactctacttctttggtgtaggaaggtactctacaagctaccaaaagagatatacgcacaccaacccagccacaaaacctttgacctacaatctgtccttcctgtaaaatatgctaaggcagtaggggcaaagaactagtgggagtagccaaccaatgtctgatttgacttaaggcccactccatgagaagaagcctatatccagactgcttggataactaagaaccagaaacctagggtaaaacaaaaacactacttacgttttaaattttttttttaaatcttaaaaaattttaaagtcaataaaatgattatggtatacacattgtatcagtgcctaatctagttactgtcaaaagaggttttctctggcagcagatggaaacaggtgcagagatggagagaccacagtcagacattacatggacagaatatttaaatgggagctctcaatcaaatactttacagcagagagcagggaagcccttggaagagaaggtggaaaaactttaagagccagaggggatggacgataccagaacaagaccctctaaatcaactacgaaagtctcataggaaatgtcataaactgaagcagtgggtctgtaccaggtatgtatgtctgtatgtatgtctgtatgtatttgtaagtgtctgtgtgtattatatatgtatgtatgtatgcatgtatatgtatgcatatacatacatacatgtactacatgtattacatatattacgtgtattacatatatatgtagtatatttatactacaaatatgtatatacatataatacacacacacataggcacacacgcatgtgcacacaaacacacatgtaaaatagctataggtttagtattgtatggtactccctggtgtgagaacgaattaggcttctgactcttatgcctgctcttgtgactcttttcctcttgtttaccaaggcagactaccatgatagtttttgcttcatcttattgtattttattttgtcatgttaaaaaaaaaatcaagaaaggaaaatatattatgatacagaaaggcatctctaacagtgaagtttcactccttcctttagaaaattcggtcagaattcaaataaaaacttaacaatgcacatcacaatctcagaaaaataagaacaacccaaactacaaactaatacctggaaaaaaaaaagaataaagaccagtatagaaattaatgtactgaactctaaaacacagagttctttctttgaagagaataacaattccttagcccaaataaccaaagaaaggcaagaccaaattaataaaattcaaggttaagatgaggacaaaataaaatgtagtactgaaaacacatgaggtctttagtaattaatatgaaaagcaacatttaaaaagaatgaagtatctagaagaaagttataaattcctcaacaggtatgatctataaaaattatattaaaaggaaattaaaaaaaactaaagatacagaaagcaacaaaactgaagcagtacatcctaccaataaagaaaagcaaagaatagattcattgctaaaattaccagttctttatagaagaacaaacggcaaaaaacctcaaagtgttctaccaaacagggaatgaaaactactaaagccattctacaaaaatattattttgagagttccaaaccaggtaagagcacttagaaaagaacacacctcaaacatactaaaaggctataaaataacctgagactattgttatgttaaataaaaaaaaatactgaagtcatttttctctaatatcagacatgtgacaagggtgttcagtttctataatattattcaatgtagcactctgaagtcatagagaaaacaagaaaaaccagaacaaaacaaatgggaaagaaaagaacaaattatctctgtaagtacacaaaagcattctttacttaaggactctgataaacacttgtagcaaaaagaaagacataaccagggcttttctatataaccctacaaagatcccaagaaacccagagagacagagtgacagagacagacacacacagagagagagagagagagagagagagagagagagagagagagagagagagagagagagagaaatgaatatagcaaaaactgacaaatgagactgcaacagttaaaaggcaaatcagtagtgaagagacaaccaaaataatggaagaaaatctttaatgcagaaaactatacatctaacagaattagtatctagaatgtctaagaacaaaaaggcacgtgccaaataaactgatattccaatcctgcactaaattagccctcttcctcaacattgtaaaactcttctgtgataaaaatagaacaatccaacccaagggcatatgtactggagatctgctttagccccacatctgaggtgggacggcatggggtagggagagatgccttcttctacccccctctcactacctacagcaggtagaactggccctttcccttactgattgaatcactcaggagcacaggtcctgcaaattgactataacagctcagaaaagctggctatggtgatgttgcaggtaagctggatgcaaggacattgagagcacaagggctgatcctgcttcattgggtaagttaagcaggatagtgcttgagagttgacctcggctgagaaaaataactcaactacctcccaagcacagacccagggcctaccccaacatctactccaattatgatctgctggaacttatgaagttgccagttctgcacatccaaaactgcaggatctccatgacacagggtaacaacaggatatccaggagtcctggttgaggatccaatacggcagaacctagaggcctcaaaatagaccaataactcattgcaatgaacatttgcaagtagagatgtgtggacaaaagcctagaaaaacacaatacaaaaggccagtaaataaattcttcccaacatattatagttaaaaaataaataaataaaacacagactaaaggatactaaaggatacaagaaaaaagtgacatcactcataaagcaggctcatcaaaattaatatctattcaacaaaagtctttaaagcatgaagtgtctggatcagtgatccttaaccttcctagtgctgtgaccctttaatacagttcctcatgttgtgatgactcccaaccaaaagattatttcattggtacttcgtaactattgctactataatcaatcataatgtaaatatctgatatgcgggatatctgatacgcaacccctgtggcagttatgactctcaggctgaaaacagctagcctggatcctgaaagatcacaactggtaacacaaagcattacacttgtaaaactttacacaaaaattcaaagacaaatagaaattttccatgataaacagaaaaaacacacatctttcaagaactctgattgtaaatggtcttaattaatcccttctccaaagatacaaaataaagaaaattagaggaaaaatctaccaggtggatgttacaattttagacacataagcaacacagaggcgcacaatttcataggaggaatgctattagatctaaaaccacgtgtcagtctcaacagtgactgatagtgggtgacttcgctacccaactctctccagcagacagatcatctggacaaaaattaaaacagaaactctggagttaagtcaaatgaatgtaatagatatttgtacaacattccacccatatactaatacattcttctcagtctatggaattttctacaaaaatcaactacctatcaagacactgaaaaagtcataatatatgaatactgtaataccatacttctttgtatagaatacaatggaataaaattagatattaacagcaaaagatattacagaaaccatgggaactaaataacacattactgaacaggtgatctctgtgagctcaaagccttcctggtctacagagctagttcaaggagagtcagggctacacagagacaattatctcctctagaaactaacacccacagtttattcatctctgagaaaagcatcataaatgatgcacaagaaaatatcttcaaacagcaaatccctgttaaaggaactcaaagacaatataaacaaatggctgaatgagaactgcagaaacatgtaggtgaatcaagtaacacaatcctgagaaccttaggacacagaggatatctcaacataataaaggaaaaacagaagaaattcctggcaaacatgttaaataacaaatgaaaaaaaaaaaaaaaccctcagagcatccttactaaaattaggaacaaaacaagcacattctgggcctgtgcttgttatttcaggttaatataatgcttgaagtgctgatgagagaaatactgtaagtgaaggaactaaagaaatcaccagtcaggaaagaagtcaaattatctttatttacaataaaatggttctattaaaaaaaaatcctgtaagtagcaaactgtaagaatctaccagaaaactcctacagttgataaacactcagcaaagtaacaatacaaaatgaagacacaaaactcagtagtctttctttgtacaaataataaacaaaaagacaaagaaattagggaaaccatcccagtcacaataacctcaaaaattatttgaataaatcaaactaaggaagtacaagagttgtataattaaattttaaaaaattaaagaaaatatgttgaaaaagcaaccagaaggtgaaaaaaaaccacccatgctcagaatgttgtaaaaatagtcattctacctaaaacaatttacagactcaatataatccccatcaaaatcatagcttgatttttcataaaaagaaacactaaaatttatttcataatacacatgacagaaaaacaatcctgaatagtaaaagaagtgctatcagtatcatcatctatgattttaagttatactacaaagctttagtaataaaaacagcatggtgctgacataaaaacagacacttcaagtaatgaaatcgaagtgaaaacttcttgatggtaagatcagattgctatagacaccaaccacatccttgaatcacagagcatggagacattatgctggtactcactggaaaactttatcacaactggctataatccactgtgctggcaagtgctatataaactctcttgagaataaaggcctcaatctcatccagttatgaaccctgaaggctaaaagtggcctgacaagataggattactaataattgcataggtgttttaggagtaactagccactatatgattgcattaaaggtctactctataaagtggaggccatactattaaaggagccaagaacttgtgaatagataaggtaataggccctagggtagaacccataccattactctgctaaatgcacataatattaaaatgactcctaatgattattgctatatcccgagaaaagcccattattttagctttcactagagaagctttgctccgtaacatatggcaagtaacagagatgatcctattccaaaactggtaagcatggcaagaaaaagaaagtgttaagtgctcaatcccaaatcagacatttatctcaccccaaagagctggaaagatggtcactcacaggtggtaaataacttcaaggaaacagtcttttccaagagcaagagactagatgcatatatgaacttatgacaagtcattacgataatacacccaagctacagccagccaaaaccccagcatgggggggtgggggtagagatgtcatcctaccacaagtgtcttatgaacccctggtaatctgactacacactacagcaggtcccaattccaagactagcctgacaatgcaaaactagactcaatggagaataaaggaaaaaaagtttgaaaaagtataatcttaaaataatggaagggttgagagggctgtaagaggaggagttgaggaagtgattatattcatttagagactagatgaaattttcaaatttttttaaaggaaaaaagaattttgtaaaaaaaaaaaaaaattaaacttcaacctcttgaattgttgaccagtgacatcccagtgatcactctcttccaatgctggctatttatttccatagtttttggttactctccagaacttgacagtaagacactactactgaagatataacacacttcagtaaagaaatggaaaaattaagcaaaaactcaccttgaagcttgatctctactaactaggatctgtacaacttgacaatgctatgcaaactatctgacgagaaaagtaatcaggagatattcaacttataaccaaccaatggtccttagttatatcacagttcattcccaaagtttccatatcatttctgtggtccaatagcaatcactgactccactattccacactaactatatatagtgaaagcatgacccaataactaatccttgtatcttccaaaataccaaattacagactcaataatctctaatttctcttttgttattgcttactttttttagttggtattcctctagttatttgactttgatgaaaaacttctcagatttcttctccatattagaaggctaatcttaggttaaagaaccttcaaaggttcaatctgaccaagagtatgctcaaaaaacccagaaaaatttttgaaaatagaaccacctataattagagttcagtttcacacagaaacttaaaagcatccgatcttataaccagaagtcaccctgataaaaatgttcagctctcataaaaaattctgaaaaaacattcaaggatcaacaaggcaaagtgatttgtcaaatggcatattcttaagatgttatgtattatccctcataatcacaggctgagaatatgtaatagttatttagaaataaactgctaccacaatatatttctgagacactaaatatttttcatacatttaatgatttttcactaacacttagtaagcaagcattaactcattaactaactattccttatatattttgctacgtattcaaggtagctttagttgtgaatttgatagtctaatgtgtagtgtgacctaagggactctcaattgagggactacctagattaaactggcccatgggtgtgactgggggaaaggggaaggtcttgattgatgtaagagggaccagtgtactgtggataatagcattccctaggcaggtggttttggactgtaagtaagtggtgttagcaatgcttaggtctgaaaattgagtcagcaacagtataaagttcctgccctgactactttgaacgatggcctataacatgtaagctgaaataaaccctttactcccctaagtttctttttgttagactgttaaatataaacagaacattaggttcccattctactgagaccttaaaagaaatgaagtgatactaaatctcagaaaggaaaatagtaagaattgagaagatgggacacaatcatattttgatagagatactcagaaaagatacctatgacaggcattatctaagaattctgaaacaagtaaaaaagaaaaacacgtagattaactcaagagggaacagtcagtaagttccagaactaaaacctcaaaagttgcaggttaagaacataatgctagtacaggatgtcacataaatgaaagagccagttcagggctgtatcaatttctaaccatagtttaagaaataggaaacctttgaaaagttgagtatagaaaagatggcttaacttttttttaatcagaaaagcccattgaattgttggtagtaaatagaggtaggaacaaaagtactgagaaacaatgatgtcccttatcaaaagatggcaatggtactacaaatgctttttaaagaagctgaaatgtattctgaagataaatgcaacataacttgcaaacagttccaatatgtgacacaaagagaaactaaggatgctttctagaatttggtttaaaataaagtcctactaaataagatgcaaatgtctatcagatttcaagggattgatagcatacaaataacagttctattttggatgaattgatttctggcttttttggggggtggtgtatacatgtgttgtgcacacaaacatggaggcatgcatgcccatgcatgtgcatttggagaccagaaagcaaaggcggtcataattttctaatgctcctcacacaattttttaagacgtggtctctccctaaacctgacacttgctgaattatctagactgaatgaacacatttcaaccaccattccatttctgcccctccaccaaggctgggatgaaaggccttgcctcactttttacataggttctgaaattctagtccacatagttggaaagcaggacactgagccaactctttaggccctgcttttagctgctttttgtgtttgtttgtttgtttgtttgtttgtttaaagccatgatctcatgtaactttgacttgccttactgtataggcgaagctgtccctgaataagctcccaagtaccgggagtacagaagtggagcaagcaaacatacccagccaaatatcaaaattcttaatacttctatatgcacaaattcataatatgaaattttcatataatccacctagatatcttctggttttctttcttcttctattaaactcatgggctaaaggacatcaatgtcaatgtgcatgttatatcccagtattaagagtctccaaaattatttgtatttcttaataagagaactttacaatctctttatttccaaccataactcctttatcttaagcataataaacaccatatgtaggattattaaaatgttattcgtctgttaaaaacactcactcatgcaataataattttaatatatgaagacacggctgtttttccaaagtttttattttcattgacaaataagaactacatatattatcatatgcaaaagtgatacatcaaatgagtttataaattctaacatagcacttttgcacatatacttaatagttgacttttagtgatattcaagaaaatatacagaaagaagtcaccatgctctacaattttggtcctgaactacattctattcattttgcattttttatgtctatcatttattctactctaagtaacaaacaatttttagaatgtttttacagtctatgtacaggaagatgatgcactacctgtttttgtgctgatttatttcattgaaaatataaaggatcatttccatccatgttgtcaccgacataagatttcagaaaaaaattttaatggcgaaaaattacatcatcatatatgtcaatttttatttgtttagccactgacaaacactggtttatttctgcattttgtttaattaatgctgcaatcaaaattaaactgcaggtatctcttataacacactatatatttctataatacaattgctaggtcattgcaatttttaggaacctgttattttccataatcgatctaatttacattccaaacaactgtgtacaagatttctgtttgcttacaacctcaccaacatgaacattcatatattctagcaggtaggaagtagtatctcactgttgtttcatttcttagatgattagaaaggtaaagaattttttttctcatgaatttgatgctggtcatggtggtacaacacctttaatctcacactcagaaagcagaaacaggagaatatctgagtttgaagtcagccttgtctacagagcaagttccaggacactcaggctacacagagaaaaacttgtctcaaaaaacaaaaataaataaataggtttttcctcaacacagaaaaagagcaagaattgaaatatttgagattctgcaaagaatagaggaaaagaaaaaatattataatatcaaaataatttttaaaaactcatttaaccactttgccatttgtactccttttttcccctgtctggtctataccaccttacttgtcatcctctggactgtagtccagttccacattctttcaccagcatagagcttaccaatcagattagccccatggatcctcctggatcttcctccccagcaccggaattttatgtgtacactaccacacactgcatttttatgttgttatgaaagttatcaaatcaggtccttatgcttcttaggcaagcattttacctactgagctatcttcctaccggaactacttgttcagaagcacctatttaggtcccctatccacttcttccatgagctgtctgaattacacatttcataaagtaactattcagcatgtgaatgctttcattcattccataggggggttatctgttaactatatcttttcttgtgtagaaagctattgttttgtataaccccattagtctattttttgtagttatgtttttaaaacaaaatttacaaacactaattaaaaagcttttcctgttttaatatattaggtgatacttaaaagaggatattaactaaggacacaactttgtcctatttaacatactggtttttttattctgcaagagtggtcagtgctcctaatagctgagccaccttgcagcctcaagaatgcttgagtcagagagtaaggcaatatggcccctgtagttaggcagacttgggttttgattttagctgatgttgtttcttttggggatttcaagacagtgtttcttgatgtagctttgggtgtcctagaacttcctcctgactgtctctgcctcccaagggattaaagattaaaggcatgcaacaccaccatactgggctaaaataaattccacttaattataatgaataataattatgtattgtttaattcagttggttattcctttctgaagaacttttgttactagcctatagtactagacttttgttttcatatgagagtaatgacttaacttatagtattagttcttcaaggtttagtgaatttcatcagtgatatcattaggttctgggctttatgtgacaaaagacttaattcctgatttttccatcttctgatgacacaacattctcaactctggccatcaataatagcatgcaaacttaaaatgctctaatgctaaaagtgttatacatgaaacactactaatggtttgtcctatctattctgctaatattcaatctaaaatattatctattagagactactggtacagtctaactgcaagcactatgaggtttctaaactaagcaggccattcagtgcatgaaactttcaacatttggtctgtttttttaaaacccttcatatcttggtaagttttcagtacactcaatctcaactcaattataactatagtgttccacaaaacatcattaaacctttttcaaaagaaaaagaaaaagaaaaagaaaaaggaaaagaaaaagaaaaaaaaagtacatggggagcaaagatgtggtggcacacactttaatctcagcgcttaggaggcaggggcaggccagtctctgagtttgaggccaaattggtctacagagccagtttcaggacagccagggttaaacagagaaaccctatctcgatggggagggggaaaaaaggtacatggggaaggcagttctttagtttctactatacctgcagctatctaggtatacaaaataaacgagttttcttttaaacaacaacaacaacaacaaaagttatttggctactaaactacaataaaatataacctcacatccattaggatgactattgttccccaaagaaattttaatatacgggtcaagttgtaaaaaaaaaatgtataaaacttttattctaagaaatgtaagtaaaatggtatagctattgtttaaaacagcatgatatattctcaaaatattaaaaatacaattaccatgatattctataggaccaaaagaatttgacaaaagattagacccatgctaatcacaacattattcacaattgctaaagcacagaattaacccattaacaaatgagcagaatatagcatatacaagcaagcaagtgttattcagccaaaaaaaaaaaaaaaaaaggaggaagttctagtatatgctacacataaacttcaagaacactgtgttatataaaataagccagtcatcaaaacaaaacaaaaactgtgtgactacacttacttgagatagttagaagcaccaaacccacagacaaaaagtagaatttaattgccagccacagtggaagaaacaggtcactatttaatgcatacaaagtttcagtagggcaaaatgcaaacagttctgatgacaaatgctcaaacatattaatatttacaataccactggctcatatactttagaacaataaagagtaaattttatacattttataagtgttttaaagttatcagagaagttacatggtctcaaaaatttaaaggataattcatagttgtttcttaagacttcacaatgtacttaagcatttaaagggatgtaatctgcttctagtaaggaaaacctggactttttcaaccacaccttaaacatagctatacacatctatctttacttcctcctcatttcttaagacaggaatgcatatgtgtgtgcattaacatagatggtataggtagatttatacatgtagagaggtgtgtttagaagtcagaggcttgttttcactatactcaaagcttgtcaattatgctaacctagcagccagcttgcctcttactccagtcttcttaatacttacatagcaagtgctatattcaccaagtctttgccacagtcccctgcttaattccttctagttattcctattttcatttttcattcctcattgtcaaattttgaaaaggttctcaatttcctacttttccctacactcaagtgtcttgcttcagaaccttggcaatgacttggcctagaacactgttcaaatatccaactgcttaatccccagtaacatttcaggattcaacctagttttactcagctataccaatgttcctactatgcactagatttcttttgcataatttggtactcctctgtattcccactgtataccaagtataattctatctcaataattaaaaaatctgattctgctctttctgaagcattgagatataagtctcaagcatctttatacccaaaacatagcacctgatgattaatatttagaacaggggtcatatttaaacaatcttgctttcaggaattataaattaatagcaggcacatagatgtttgaatcttcctctaattcccctatttatcaacaactgccaagggcacaaaaaacattgaaaattcagaatcatgtatgtaattatctacttaccattagacatctaattttttgcagaggtttggaagtatttggttaggagatataagtagacatgttccaatctctagatacaatttaaagttgttccttctttttctttttttaattcaattttacctttttttattttaagcctgaaaggtattttcaaataaaatagtgtagggcaacttgagacacaaaataacctgaacgaagttatacttacattcggctagcttcaatgtcctcagactgggattctcctggtgatctgtaaaatgtaattaaagacaaatattagtgatttccaaaaaaaaggtatagaaatataagtaaggaagataaactggaaaacaagacttaaattccaatgaaagggtgctttaaaagatttaaaactaagaaaaaaaaagtagaaagatcagattatcacaacacatttaagaacaaattttagaaacctcaatgtttaaaaagaaaattaaaatctttatatttagatatcaaattagtataagccataattatttacaatgtcaaacacatattaaaaaacaagactgttactttctattaagttgggttgtggtattcatagtcttgaaattaaatgaagtgtttgcaaactgtaacctgagcaaacactaaggtgtaggataatcacctttattttgaagtgatattatactgagagatttgtattcatttatacactgtctatgtattcagaaaaagcaaggataagtacttgcagaaaaaactatttccttcaaaacctaaaacattataaaaaaaaaaaatcccttgaaaaatgtctgccaatttctgcagtagacaatttaaactcaaatataacagtgttcatagatctttaagatatttaaatgctatgcaccattctaatcataattcctgtggttctataaggaaattagatttccctaaaaagcactatctgccgtcaccgtgtatatggagcattatgtttgctagataattgtaggctagttttagttttaatatctgctggttattttctttattttttaatatattagctaatatagaaatacatataaagcaccaaagagtatcccatttttattgggtggaacataagccaatttccctattctgaacatctggttaaagaacaaattccagtgatgcacacagcaatactttgctatacttcctgtcatcagaatgctaaaccaggatttagcatgaggacaggctgttctacatagtgagacactgcctcccaaaaagaaaaaaatctgttaccctacatatctttactgtgagacaatcaatgttctaaggtaaatttattttaatacctatttctaatgctttaaattcccaaaataggttaagaaagaaaagaataatttaaattttcaaatttgtatacaaagacaatctgtgaatttactactgactttagtctttcaagttaaagacttgatttgtaaatttatcactgacttcagatattcaacttaaacaaaaagtttataaaaggctggttgtggcttatggttatggaagattttttaaagcaatgattcttaagttaggggataaagaagaggctcactagttaagagcacttactgctcccagagaaatcaaggtttgcctcttagcacccacacagctgctcacaaccatcacaaactccagttccagcactgatgccctcttctggcctatgtgagtatcaggtgcacatgtgcatctggtacacacatacatacctgcaagtaaaactcacacacagaaaatttaaaaatcttagccaggcaatggtggcgcacgcctttaatcctagaagttggagggcagaggcattggatttctgagtttgaagccagtctggtctacagagtgagttccaggactacacagagagaaatccctgtcttaaaaaaacaaaaaacaacaacaaaaaatcttaaaaattaatgtattcacttctttagtgtcaaagaaatttcacttctttgcttgactttcaaaataatactcattgtaattcatttagattccaagtcagtaacacacacacaaagaaaaaggaaaaaagatacgattaaaaacagaccccaaaagctcagacagtttagattttcttagtagtttatttatatttttctgtttatcacaaaattacataagaattgaaaaatgtagattaggagtgatatcaaataaaaaattctccaccctcttcccccagaaaacaagcaaatatctcagaaataatgatctctacagccttaagaaactaccaagattgtttccaaacttatatctcatataaaatggctagaagagttaaaacatgatggtaacccatgcactagctaactcattttggaatgtgtctttccaacatctcatatattattaagactgtgagataaagctgacttgcaaaacaacaacaaaaacctgttagcaattaggaagccaaattagaagtctctaaacaggtaggaagcaaagtgttctaaatgtacaggaaaagaaaaatttagagaaggttaagaatgatgagagaaaaaatattatataagaaaatataagataagagaaaaaaagaactatatctcaagagaatattatagaactgctgcagtttcaagaccctaaaatgaactatagaacaaacatattgtcaaatggccaactacagctattttcgcaatttctgattgctacagagtatgtgaatgccagtaacataatgccaaccaagtattgtaaatatactagacttctatttaatattcacaaatattagagtaagttattaagcaccatttagccaaactaaaatttaagaaaccccagaaagatcagagtaaaattaatccaaacaaattattcttcttaaattatactcttcttgatctcttagacatagtatagcagaggctgctcccattcaaacagttttactttagtcaagagaaaaatatataaatacaacaaaagcatgtttctgatcattgtgtacatctgaatgtctatgcagacaattttaataatattctaattaagttgccaaaatatatcctaaaactagagttaactttcaaagtaactctatttttataactattagtaggtgttacaaaccacaaagtatatgtaacacctactaatagttataaaactgttctctgctcttaaaatgcttgctgctttttactgacaatacatttgaaataagaattcaggacatgctcctaattttaccaaattcaaaatatagaaccaactaaaagttaataaaaaatccactaccaacccaagactgacccaagttatcctaaagtttaccagaatattaataaaggaatgaatgaaatttgaaacctgaaaaatacctagtaacaatggtgaggaaaaagtcttttaaaagtatcaattttaggtattaactttaaagacagaaaatgtaatcacaaaacaaataatctgaacactggaacatgacctagtaaatccatccttttaaggaggtaaaggtgcacttttaactccactgtaactctctaggagaaaaagtacactcattttactaaaggtgcaacatttctggagaagcactgaaactcctgccacataaaatattaaaaataatacttaagatattttccacatatctcttaaaatgtccacactgtaatcttcaaaatacttaagacatattttcttattaatctatgcagaaaaacaggtctttgatgattacttatcttcatgaactgaagggtaagtaagaaatgcactataataaatatctgagaaaggaggttaaatgaagaaatggctccgttcttaggtcttttattcttagcaatattcctgctacctatgcatttttgtcatttttatagcacataattcatcttacaatgacagcctttctaagactgtaaaataacattcaaaattaccttttacaagctgtggccattcggtgacatcagggtgataacagctttgagtcactgattaaaaacaggttgtcacaccagtctagctgctaacttgatctgaacgtaggcttaataattctaataaattaaacaaacctttagttagaacactagcataaacccaattcattgttcaagtcattatcttcaaagctttaaatcagtagtcaatataaaattagaagaataattatcacaggaaaacctttatgaactattcttcagtatattgttttcttaaatggtctcttcatttgagaaaatgaggtatattctcaatccaaaactactccaaaatccagaatgttttaaatcatcatggcagcaaataaaaaagggctggatttaggaatatttccgattttgaattttcagactaggtatgttcaaacagtaaagtctataggaacatgccaaaatctgaaaaattcttaaatttgaaacatagtctggtcccaggcatttctgataaagataataatccctacttttcaatgtagtactatatggctcacaaaatacaacaatcaactgtacccttacattccactgactttagctctacaagatcaaaatagaagaataacaataagcagcctcagagtgattaactgacttgccgaagattttgtaaataatgttgaaattaagaccaaaaaaccaatatcagctaaatttccactaagtattagaattttgctatggtttagttttgctttacagtgttttgtaatttaaatacatacaaaaagcaaaaatttagactatgtattgtggcagtaattagaatgaaactgatttagtatcaagagtctttaactgatgggagaaatcagctaccaaacaggcaaaatcttgattaaagttttacacacacacacacacacacacacacacacacacacacgcacccacacatgaaagagagagagagagagagagacagagacagagagacagaaattatttaagtagtataatctatcattaacttttagacctttggatctataagaaagcattcgttttcaatcccactaagactcaattctaggaagtaatataaagcaaaatatgaatgaatatcctattattcacatatctgaactatcatatgtgattttaaacaaatctgattcgtttcacagccctccttatcatactatactcctgacaaaatgccaatactgttatggttttatccagttttcccccaaaatcctctttcactgatctataaacatagaacaaatttgaatgagcttaaaacaaaacaaaacaaaacaagaaagaaagaaagaaagaaagaaagaaagaaagaaagaaagaagaaaagggagtgtaagattaggaagaggaagccccttcacaattaacaccctcaaattgacagcacagacaagccagatggctgaaagcacggaatcagaacccaacttaaaacaggaagtagtgagaatcccaaaggaattattaaagcatcaatatttgaacccatattattgttagagttggctcaagtttatattatatatatatatatatatatatatatatatatatatatatatatatatataaacaaaatcagggggtcccaataaataggatttataacccctgttaagaaataacccaatttcccaaatttccctatcataactatttatcttctactaagaacagaggcatcactgaactagcaagggagagaaataacatccttgaaataaatgtggtccatggcatagttcccttagtttctcatcaaacagcttatgtggaattatgtgaatactgaaatgaatctaacttctaacttacaaacacaaagataacacagcttaaataaaatcaactaattcattaaagaactatatatactcttaggattactaaatcaagtactctccactagtctcctctttattaggttcaatgttcagttgaacagtttccaaagacattctaagattccactctccatgatcacttactatagggaaatcttggacaagttacataacctctctaaacctcaattatcttaaagcagaattaaaaccctagtctgggttatcataagagtgccttatataaaatatgtttgcaaataaatgaaagagatttttcatacccacagcctaacagccaagtctatttccttgaccttcttgttcatattactttgtctcataatacagtaaactcacaaattcttccaacaccccacttatatccctcacagtctacctggttgtatactcagcacctagtaagagtctttaaaattgacaggcgcccaaatttattgaacgcatttgtcattatactagccgtaatattaaaataattcatgcaatatgaatttcaaaaaataaaacagaaacataccatatttcgccaaacttctgaggagctggtgaactctaaaatcaggctcttagagagattttttaacctaaaatataaaacacctcactcaattcttttaacataaactggatagtctttcagaaaaaaaattactcaaattcattataaaataaaagccaatttctcttcaataatacttataaagatccaaaaatatattgaaagacaaattaccccactcctattgccaagaaaagtagcagggtagctctgtaggctgtgagctgaatattttccgactaggaaagccatgtttcccatcttcatgtacaaaaagtaatgctccacaatccctttcctcaaaccccttcagatatctacagtaagtccacttccaggtaatctctatatgaaaaacttctgctatataaaacctagagtagcaaccatggctaaatcctctgacctgtcagtctctcaagagtgctaagttgttgaattagagaaaatgtataaaaagaatatagatgctttcctgacacataacagggctctgttactcaactaagtcactccatgtctatcacaattctttacaaataaacaataacaatgtacttattacagagcttaaaacaagctctcctatgattttaaatttgtgttcatagttcatttataacttgtcttgaatatttttcagcctttaatatcttttaatcttattttgtcataaggagaaaacctaatcctatggattaagcaactacaaaataaataaatctgcatattatttataggtaaataggttggcaggtaggtgagtgagaaggaaagaaggaaaggcaaatggatgggctgataaatgatggatgggtgggtggatggacagacagattaataaattgatagatggactgatataacactatggtctccccaaagataaactttatcacatactagtaaatcctgtggcataacagtaggattctcgttccaatgactcaaatcagaaaagttcaaatcatcctgccaaatataatatattgctcactcactgctaccaattccacctcagggatctccccacaatccaacactatccctaataattctccagtggcctttacttgctttcggtatagcttaattgctccatcacaatatgtaaaactatgtttccaaaccctgctagtatacccttccttccagactagacaaaacattgagagtatgtccttaatttttatactaaatgttttaaaaggtttatagaataaaacagcacagaaaaaaaaaaaaaaagaaacttgggtagctatgtaaatgcaaggctaagaaacttcaatctgtttcaaaagactatccatgtccatttccttataaaccagtctaactcaaagtcacgccggaaaaattagctttaaaattcttttttgtaatatttcatctttaaagaaagaatccattgcttcttttccccacatggttactaagattgttgtgatacagagtcttgtcattttacctcatttctctcttacatatttgacagaactatcctcctagaaattagaatttggtcatatccctctcatattaaaaaaaaatccctatgccttctcaattctgttaacataaatttcaaacttttttttacatattaactgatgtccttgtcatatggtcacatccagtaatccaaacattacccatatatgatgacatcctgaaatatcaatctcccttggttattgtactctatcatatatcagaaatctctatttctggtcctaataattttgcttctcaggatattccacaagaaatgttttcctgtgctctgcaatttccatcctctctttatctataaaagcctatttaaaaaacaaacaaaactattcttcttaaaactttagagcaccccaaatgaacaatgacagttaaggactgagaatgacaataacactaacaatgaaaaaaatcagaaccttcacatattactaataaaagtatttcaaaggaatataaatatatagccactttgagaaaagttttaaaatgcctctagttttaaatagttgccatatttcccagacaactcacacctagatatataatcaagagaatgctatatatttacaacaaaagttaaatccatatatatgtatgtattatatattatatatctattatataatatataattatttatgtgtgtgtgtatacacacacacacacaaaataccataacaacccaaaatgaaagcatacagaagcccatatactgatgactggacagataatcagctatttaaaaaacaaacaaacaaacaaacaaacaaaaaaccaaaaaaaaaaaagaaacaaaaaaaaaaaccttgtagagtttcttttcttttaaatttttttctgtaaattataaaacacacagaaaattgcttagcatacagcaggccctggatttcaaactccagcacttaaaaaaaattaattaaaatcattaaattgaagcatgtagaaaaaaatcataaaactcttatcattttaccaaccactcagaattaaagcaaacacaaaagatgccatttgatatcattatttaaaatctaactattccaagtactggttagagatgctagaaacaaaaatgttcattcactggtgatacagtatatgttggcaaatcaaatttacataaaatttgccgtatctaatcaagttaaggatatatcctattttctaacaacttcatccctttaattttccctaaagaaaaccttttacaaaggaagtataaaaatgatctgcgcaatataggaagcaattcaaaatattcataagcagtgggatacaatactatttagttatccatatactataataccataaaagatatgtgtcaacatacacatctcaaaaacagataaaacacataaaataaaacacataaaataaagacacataaactgatggcaagtatgtatgaaacacatctataaattcttaagcatgatatctcacttattggcaaaggtcatatttaagtacaaaacagaagatattcaagaacttcaagaaatctcttacatggataagaagagagggtattaggacttggaggaagagattaagtttccaaaacaaaaatcaaaactggcatttatattccaggatggtaggtaagtagattattgatatactattaagtgctttaaatattttataacatgttttaataagaaacaatctgaatatacaatttctaagctaaaaacaaaaccctaagactatggagacttccatgacacaatcttcccaatttattaaaagtatgctaataagataaaaatgtatggctcttgagattatctccatgagtaggataaagccatataagcctgacactttaaaaaaaaaaaaaaaacactctgggattaaagttaaaaattgagagaccttaatctacctaactatcctctgacctccacccgcatcacagcatggcactcttatgtccaaatacacattatacaacacataatgataataatagtaataataattcaaaagattaagacaaaatataaaggactaaaggactagaagaaatgttccctgggtttaatgccaagaaccccccccaaaaaaaactattattataacatgataattttaagcgcagaataggtgtctaaataattaagctattatctcttgaccactaaaaagacgaattagtatcaatttttaaaagaccttcagaaggtctttgttaattgtccaggccactatagtactgcttaattctgtttacctttaaattctcaagcctagagaattatgtattaccatacatacatatttcaagagcctacagcagatatcctaacccagacctgaacaatctagaaagtagttcattcaatccaacatttacaaatacctgcatctgcagaagggaaaggaaaaggacaaaagggagagaacagtgagagaggaaagaactgggagacatgaggttagaaagagagaaaaaagagaagaggaaagatggaaaaagggagaagacaaaggatacagaatacaaaatgtgtacacaaacatttactgttctcccagactcttcagtataggaatagacatctaatttcaactggttaagttatgtgcatatatctgtttttacgttcacctcttccctgtgtttcatttaactcaaaaaaaaaaaaaaaatggagtaagagaaaatttcagaatcagtagaaagatgatccatacaaagttaaatcagaccaaaacaatctttcatttttaaagtgacatgaaacataatgtaccagccagtaattatacatgatgttaagtacagataaaagactaaaattagctcagttctcctactatgctttaagagctcttactttaaaattatatagcccaatctgtagaggaaagtatattcctcctttaagttcctaaacttgtacataacttcttattcccatctccagtctagaatcctgtacaatgttatagaatcagtgagaaacagtaacagagaggatggagaatgggacagaatttccaagcggagaaatttcatttctttgaaactaaggatttggattttcttaatgtattttctatcagtaacacatgatacagagtcaggtcacttcaaaagtgaggacaaaaacatattctctaatgagtctttatctgaaataagatttatctattattatacatactatacaacaggtactcaaaaaacaacattttaagttaccaaacaaaaacacatttagcaaaggcaaatattatctttatttttagcatattgtacgcttagcaaatatatctacacaaaggggcatagtaaatagaaatcttaagggagaaatactaataaattgaggctactctacttccccttaggatgcactaggcattatttttcttaaaaaagaaaaagaaaaagaaaaagaaaaagaaaagaaaaaaaaagaaagagggactatgcatttcatcttttcctttccaaaaaaatagcagtatgattcacatctgatactaggtaaagtgctgaaacctataatgagaagagtggtatcaactaatgaaaacaaggaatgagtttcagaaaagacaagaattcaaggaaataacaaaatataaagtttgttcaaactaaatggtacattacatggttggtttcttttaatttcttctatattgttcatatcttctatatttaactagaggtatcagcatttattttatatcacagattataaaactaaattaattatggccatggttccacaatggtatctctaagactactttttcatatcagaaagtccattagaagttttaagtgaatagccatctcttttattcaaaaaagcaaaaaaacaaacaaataaaaaaaacataggtttttgttttaaaaaaagaaaaattttatcacattaaaacactgttctgtcgggcagtggtggcccacgcctttaatccctgcacttgggaagcagaggcaggcggatttctgagtttgaggtctccctggtctacagagtgagttccaggacagccagggctatacagagaaaccctgtctcaaaaacaacaacaacaacaaaaacaaaaacaaaaaaaacaaaaaaccaccgttcagaaaagtacaacactgacagtatcttcattcatgtcatagctatgtaatttgtgtgccaaactgcttgctttaaatgtccagaagaacattctgaattgaagatatatgcattggacaccacacacacacaaaaaaaattggttcacacccatagtccccagcactggagcagtgtaatcagaaggataagtaggtgaggttatcttcaactactaagaaattgagaccagtgtggactacaagatattctgtcttttaaaaaaacatataaaacaaacaagaactaaaaagtgtctcagcacttgggccgaagaccaagaattcaagggcagtctgcactacatgtccagatacagtctatcctaggttacataccatgatttttatcaactactactactccgccgccacctccgccgccaccaccaccactgccgccacagctaccaccatccatccacgcacacacccacacacataccccatcaccattcaaactagatttctaaggctccataacatatttttttcaaagtatttttttcaacctagtgatgtagctcactgctaggtagcaaggccctgtattctatccccagctatgtaaaactaaaattgaaggattttttttaatatctgatttctgtcaaattaatgagagttgtgctatactgcttaaatgatgttgacaggtaagaaagaccaaattctgaaatgtactgagctgctgctaagagtaacaacagattacacacaaggttatgtgtaaggaaaattttatcctgctcatataaaaagttcagtacctatatactactactactactactctggtttcactcaaataaggatgccagcttcagcaagatttacataggattctccttcataagcctaatgcaatttcttcgtgaggcttctcctcagatttgctacaactgaactgcaagaataagcttaactatggtactatggcccctaaaggctaccctttcccatcattcttataactgattcacttgcaattcatttaattaaaaatcaggtcaagaagagcaaatgacaaggaattcagctttgcaaataacttatcactaacaatttcatgttaaatgtacattacttatttctaggttttacctgaagccacagaagtaataagtgcttcagaacttcagtggtttaggaaacaaaacaacctaagcttattgaaatagttatcaaatctgaaactaattcatatattgtaattgcggctgtaaaggagatatacccctgcaatcccagctctcaaaagaggtacataccagaaagaccaggaggcttagccatgttaacagaaaacaatataaccgtattccatcatcctttctcctacaaatttcctgggcaagttactttctttatacagtatctatcaatgttcaagaagtatcacatatgagcagcataatcctctgtaacaagaaggcagtaccactttaatatgattaacaaggccttagaaagataaatggcctgctcctatttagctcactctggctcaagacagatgtcaggaaagcagcaacttctgacaacatgaatattgcattctttattccatttcaataatcctaagttgttttgtttcctaaaccactgaaattctgagccatttacttattctgtggcttcaggtaaaacctaaaagtaataagtaatgtatattgaaacctctttcaaaaatcagtataaaaaatttttttcatgtatagataggcccaatacttataatctttccaaattactattcattagtttagttgttatagacaactgaaatcaagaaagtataggtaatattttgaaattaaatgaaaacaaaggaaatctgatgtgtacattaataagtcactttattaagaaggaataagtgtcatgtatttcaagcctttcatggttggaaaaagaaattgagaaaaataataatatttctacttaatacaatttatttcacatcttttatttaaaagaattaaatcctgtgctatcttataaggattatattttactaatagtataaaaatatataactccataaaagtgaattgctaattgcaaaataagtgtagctattcttccaaacaaacatctctgactcttattattgaatcagaatggtaatcattgtccaaataaatgagtcctaacaggctgagtagcatactagactaaatctatttcattttatatataccacatgtgcatgtgtactgtaaaaggatattgatgggctgcaagtaagacatgaacacatataccaaggatacaaaaaaggatacaaacagtatcctttacaattgtagctaaggggttaagggatattaagtctacagaactgccctaaaactggaggggcacagacaattaaattccataacttaacagaattatcacattaaaaaataaaatggtgttatgtgcaataaataaccaacctatcagtttccaaatgatagatattttctttttttttaacccttataacccatgtcagctcacacaattcaaaggagcctcagaaacactacctgatactgataactatttcagacatattcttctatgtgatctgaatctttgcacccccccaaaaaaaaacttcactaaaagcctaaaatcggaggtgatgaaattacaagtgtaatttttaggaggacctacattgatgaatgagagcaatgtcctaattttaaaagaccatttagtcttagctgaagcaggtggatctttgagttagaggccagcttcgactatttacctagcttcagaggctagtgagagacactgacacaagaaagggaagcggggaggggaaaaagacaaaagaaaaaagaaaggaaggggagggaaatatagggaaggctggagagatgattcaaaagttaaattaaaagcacttgttgctcttccagaggacctgggttcaatttctagagcccacatggcaattaacaactgtctatatcccagtcacagcagttccaacactctcttctcacccctacagacaccacaccaatgtggactctcatataataaaatcaaaaaaagaacaaacaaaaacaaacaaacaaaaaccctaataaacagagacagagatacagagacatagtgatactggcctgcaatcacagctcctatggaaggcggcaggactcccatttcaaggtctgagctggagtgtgtacagaggactaggaagtggtagagcagttcctagaacttgagaggccctaggttcagtccttagtcctcctaacactactcaaatttacaatgaaaattagttctgatcttaagatttctcagtgtccttgactgtgagatacattttttggagttggggggaaggggggtgttgaccagtctttggtattttataaataggccaaacagacttaaggattctggaaacatagtctgaggccagcctggtcaatacagctagctccaggacagccatggctacacaaagaaaccctgcctcccaaaaatattaattaattaattaattaaagaaaaaagttttcaattacacattctatgacatctctgattgataacttttttgagacaaggtctcgcctcttagtctaggcttgccacaatccttccttagcctctcaattgttggtttacagatgtgagacatcatgcctaacataacattgtctttatttttatcagtaagaaaaagtaactgtcaaaaccaaaactctattatcctaagcctttctgaagagaacatcaaaagacttagaggactatttttatatttttatattgtttttccgtatttgaaagtacttaaaagaccacctcttaaaactcatctccagttgcaaaaatcagaacactgatgtttttaatagctgcatataaatataatataaatccattaacagtaatattatcaataataacaaacaaacctaattagaataaatgataatataccagtaaccattcatttaaggtgttggtttttttaaaggacatttgaaaagatcatcttaagctcttgaacagaaaaaaaaatagctatggccaattaaaaagaaaatgttcataaaaattgagagaaacaattattactgcaattatttgagggaagacacaaatgtttaagaaatacaactgaataaaatttacatgtcagagacattatagatacctaatgaatgcaatgttaaaaaaaaaaaaaaaaaaacgaatcaaatagaatgagttttgtctcaggtagaaatcacatttttctaatttaaaaccataaaaagggtaaatagccggtcctggtggtatacatttttaatcgcagaaccctggagacaaagccaagaggagagttagacgtcatccagcgatataccataagaccctttctcaaaaaaaaaaaaaaaaaagggtgatggtggctatttcagggataaaaaagccacctacaaaacctgcatacaaaaggaattttctaaactcaaagttaagctcctcagttatatgaagagcaacatccaaagaagtatgtgtataccacttcacaacacaccatgcaaggtaaatattgacacaaattatttcacaacctacattctgattttgaaaacaaaactacaagtcatctcatctttattatgtgctgtatctttcttaaacgatagactgcgaattgttgaagttctcatttttattacagattctgatacatggcttttttgtaaagctaagtatttatggatttacagtcatccttacttaggcttatcagcaatacagatgcagtatccacttccttaaaagtgcagtaagcagtctatttaagaggagaatttaatactaaagcaatttctgtcatacataacaagacaaaattttccttttatctctcctcaattctaaatttacataatttaccaaaaagatatcttaagagtattaactaatctgaggtgtgtcaaaaacattcgtcgtgtctcttgtccaatagggctttgatatttagctttttaacagctgtatttcttaaagttcaggccatctttatttcaaacgcacttccctatccaaaacattttaacataatctgctgcttctcccaaaaccatgggttatacgaatatccttcacgaagtaagataatggtggataacacatcccatatactatttagttaacatttccaacagtacactagctatttaacgcaatcccaaagagattttatactgttctattttagcatgctcaaaagacataaaaaaaattgacgtaaaattgtctttagaggattcttctaaagctgataaagtcttattaaaattatactttctatttttaaggctaacgcaattatagcacattcaactctgattcttccaacaaaaagcctccgcatcaaaatggggaaaacgtccttttcattttctcaactgaaaagggggaggggagaagaggaggaggccaactgcttacaggtttgcattgaaaattaacacagcagtttctgaggaatcagtaactcacgttcaactactgaatcctaccagaagcagcacacgaataaaaccagagcgcaatccttgggcttgaggtgccgcttcatccgtcttccttccaatccacccccaataccccaacccactaagcacacatctaaatatgtcttccccaccagagcgcccctttggaggaaaaggcctgcctttcgcagcctgaagccacggctggctctccgatctctgcttagatgaggcccccgatctcgacgccctgcacgtccgccccaccccgggcccactcgggtacccgtgggtgacaaaaccctccctcctgcgtccagccagcactgacagttaaggctgcagcagccgcagccaccagggcctagtcctggcaccggcccctccagaccacgcgccccaagcactcgctcacggaggcgggtgagggcccggcgcctaccctgtcagcgcgggccggagggtgacgaggggaccggcggtacagaccagagggagcgcgccgggcaggccgcagccgcagcagcactgacctgtcctcgcccccgcgcgtgggctgcggccctcgcagctgcggccgcctcactggtccttgtcgccctcgtccaccgccgccgcccgccaccgcctcgttccctttcgctggcgccaccgccgggtctcatgcgggacccgcgcttctcctcaggaaaccgaggccgagaggccaggcgcctgggcaaccttgaagtcggcgctgaagcgctgctgtcgcgatctgtccacagtggggggcgagggcggcgagcaactccgaagagaagcagaaggaggcgccaccgtcagcgacaggtcgacggaagagaagcgtaacgag

SEQ ID NO: 2 - DNA, 20 bp, Artificial sequence
  Synthetic oligonucleotide
ctgggaatcatcatagatcc

SEQ ID NO: 3 - DNA, 20 bp, Artificial sequence
  Synthetic oligonucleotide
tgactgggaatcatcataga

SEQ ID NO: 4 - DNA, 20 bp, Artificial sequence
  Synthetic oligonucleotide
gtttgactgggaatcatcat

SEQ ID NO: 5 - DNA, 20 bp, Artificial sequence
  Synthetic oligonucleotide
aatgtttgactgggaatcat

SEQ ID NO: 6 - DNA, 20 bp, Artificial sequence
  Synthetic oligonucleotide
aggaatgtttgactgggaat

SEQ ID NO: 7 - DNA, 20 bp, Artificial sequence
  Synthetic oligonucleotide
ccaaggaatgtttgactggg

SEQ ID NO: 8 - DNA, 20 bp, Artificial sequence
  Synthetic oligonucleotide
tttccaaggaatgtttgact

SEQ ID NO: 9 - DNA, 20 bp, Artificial sequence
  Synthetic oligonucleotide
agtggcggtacagagttttc

SEQ ID NO: 10 - DNA, 20 bp, Artificial sequence
  Synthetic oligonucleotide
agagtggcggtacagagttt

SEQ ID NO: 11 - DNA, 20 bp, Artificial sequence
  Synthetic oligonucleotide
tgagagtggcggtacagagt

SEQ ID NO: 12 - DNA, 20 bp, Artificial sequence
  Synthetic oligonucleotide
cgatgagagtggcggtacag

SEQ ID NO: 13 - DNA, 20 bp, Artificial sequence
  Synthetic oligonucleotide
ccttccctgaaggttcctcc

SEQ ID NO: 14 - DNA, 21 bp, Artificial sequence
  Primer
catccagagaaagtgtcacca

SEQ ID NO: 15 - DNA, 24 bp, Artificial sequence
  Primer
ctccaactcatcactgtaggtatc

SEQ ID NO: 16 - DNA, 33 bp, Artificial sequence
  Probe
agctcattcagatatcatcaacttttgtccagt

What is claimed:

1. A method of inducing expression of paternal UBE3A in a cell comprising contacting the cell with an antisense compound comprising a modified oligonucleotide consisting of 12 to 30 linked nucleosides and having a nucleobase sequence comprising at least 10 consecutive nucleobases of any of SEQ ID NOs: 2-12, wherein the modified oligonucleotide is complementary to an equal length region of a UBE3A-ATS nucleic acid that contains the pre-mRNA for SNORD116.

2. The method of claim 1, wherein the UBE3A-ATS nucleic acid has a nucleobase sequence at least 85% identical to SEQ ID NO: 1.

3. The method of claim 1, wherein the modified oligonucleotide is complementary to an equal length region of nucleobases 545131 to 776518 of SEQ ID NO: 1.

4. The method of claim 3, wherein the modified oligonucleotide is at least 85% complementary an equal length region of nucleobases 545131 to 776518 of SEQ ID NO: 1.

5. The method of claim 3, wherein the modified oligonucleotide is at least 90% complementary to an equal length region of nucleobases 545131 to 776518 of SEQ ID NO: 1.

6. The method of claim 3, wherein the modified oligonucleotide is at least 95% complementary to an equal length region of nucleobases 545131 to 776518 of SEQ ID NO: 1.

7. The method of claim 3, wherein the modified oligonucleotide is 100% complementary to an equal length region of nucleobases 545131 to 776518 of SEQ ID NO: 1.

8. The method of claim 3, wherein the modified oligonucleotide is a single-stranded oligonucleotide.

9. The method of claim 3, wherein the modified oligonucleotide comprises at least one modified internucleoside linkage.

10. The method of claim 9, wherein the modified internucleoside linkage is a phosphorothioate internucleoside linkage.

11. The method of claim 3, wherein at least one nucleoside comprises a modified sugar.

12. The method of claim 11, wherein the modified sugar is a bicyclic sugar comprising a bridge between the 4' and the 2' positions of the sugar.

13. The method of claim 12, wherein the bridge is selected from 4'-CH(CH$_3$)—O-2', 4'-CH$_2$-2', 4'-(CH$_2$)$_2$-2', 4'-CH$_2$—O-2', 4'-(CH$_2$)$_2$—O-2', 4'-CH$_2$—O—N(R$_1$)-2' and 4'-CH$_2$—N(R$_1$)—O-2'- wherein each R1 is, independently, H, a protecting group or C1-C12 alkyl.

14. The method of claim 12, wherein the bridge is 4'-CH(CH$_3$)—O-2'.

15. The method of claim 12, wherein the bridge is selected from 4'-CH$_2$—O-2' and 4'-(CH$_2$)$_2$—O-2'.

16. The method of claim 12, wherein the modified sugar comprises a 2'-O-methoxyethyl group.

17. The method of claim 3, wherein at least one nucleoside comprises a modified nucleobase.

18. The method of claim 17, wherein the modified nucleobase is a 5-methylcytosine.

19. The method of claim 1, wherein the antisense compound induces expression of paternal UBE3A by at least 20%.

20. The method of claim 1, wherein the antisense compound induces expression of paternal UBE3A by at least 50%.

21. The method of claim 1, wherein the antisense compound induces expression of paternal UBE3A by at least 100%.

22. The method of claim 1, wherein the antisense compound induces expression of paternal UBE3A by at least 150%.

23. The method of claim 1, wherein the antisense compound induces expression of paternal UBE3A by at least 200%.

24. The method of claim 1, wherein the antisense compound induces expression of paternal UBE3A by at least 250%.

25. A method of treating Angelman syndrome in an animal comprising administering to the animal an antisense compound comprising a modified oligonucleotide consisting of 12 to 30 linked nucleosides and having a nucleobase sequence comprising at least 10 consecutive nucleobases of any of SEQ ID NOs: 2-12, wherein the modified oligonucleotide is complementary to an equal length region of a UBE3A-ATS nucleic acid that contains the pre-mRNA for SNORD116.

26. The method of claim 25, wherein the UBE3A-ATS nucleic acid has a nucleobase sequence at least 85% identical to SEQ ID NO: 1.

27. The method of claim 25, wherein the modified oligonucleotide is complementary to an equal length region of nucleobases 545131 to 776518 of SEQ ID NO: 1.

28. The method of claim 1, wherein the cell is in an animal.

* * * * *